United States Patent 9,675,668 (MODIFIED POLYNUCLEOTIDES ENCODING HEPATITIS A VIRUS CELLULAR RECEPTOR 2) - sequence listing, part 6

SEQ ID NO: 5931 - DNA, 4656 bp, Homo sapiens
cgcagctggtgctgtggggccgcggagccgcgcgtcgctgtctctatggccccggatccgagcgcaaaggtgagcaaggcgaggagtgcgggcggcgccctggcgtgagcctggggctgcgggccgggggtcgggcaaggcctcccccacgtccattctaccctccaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccaca

SEQ ID NO: 5932 - DNA, 4832 bp, Homo sapiens
agttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtc

SEQ ID NO: 5933 - DNA, 4792 bp, Homo sapiens
aactcctcccccaccgccccctccctccttctgctcccgcggtctcctcctccctgctctctccgagcgccgggtcgggagctagttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 5934 - DNA, 3791 bp, Homo sapiens
agtgcttttgtctggtgctgggagtgaggctcagcagtgtgagggacaattggagatgctcgggggcaggctgccgcgttgtgtcctgcttttctgcggccagaccaagccgtctggagctgctggtcaggttttcttgctgacctcacctgaccacagtggcctgggtggactctacagggaaatgttgttttctccctgggagcagtagcagcagtcctggctcccctggactgagaactcctcatcagccccaggaagcccggaccccctttcagggatctggaaccggtgtgcctgtggccccaggtctgctcccaggcgtgggctgaagtcctgacttctgtcgctgggggcaaggagtgggagagcccagctgctgcctgggctttggcagacagcaggctgatggtgctggcttccccgagactgcttctcctgcctgctgtctgatttccctgcatggtgcccgcagctgagctgctacggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccg

SEQ ID NO: 5935 - DNA, 3551 bp, Homo sapiens
gtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttctatggagactatcttccagttgctgctcaacagagttgttggctg

SEQ ID NO: 5936 - DNA, 716 bp, Homo sapiens
gcggccgccccattcccagaccggccgccagcccatctggttagctcccgccgctccgcgccgcccgggagtcgggagccgcggggaaccgggcacctgcacccgcctctgggagccagcttgggtccgggttgcactgggccctgccagggctgtggtcggcgcatctgggctgcagcggcgatggggacccgggacccaggcctggagaaggagacggacgagtgaggctgagggacggagggacagagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagcca

SEQ ID NO: 5937 - DNA, 558 bp, Homo sapiens
agacatccgtgttccctggctcaggggctcatcgtccttccttcctctgccaaggctgaggcgcagctggacaggggagcatccatcacactcctttcccgccagccagcagcggcagctctcctggcaggcaggggatcagctgtgcctctccttactccactgctcctcacccctggacccagggcccaccctccatctctccttgtctggtgctgcccacgtctgcctgcagaccacacctgtgagcacttgactaagtcttctgtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcc

SEQ ID NO: 5938 - DNA, 4108 bp, Homo sapiens
gtataaaccacatgctgcatctgtcagcagaggaagccattggctgcgtgagggtcagaaggagcttcatagatgagctggcatttgggagagggcattctacagggacgggcaagcagaagcgaagggatcgagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctg

SEQ ID NO: 5939 - DNA, 4256 bp, Homo sapiens
gaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgatatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgacatttcaactcctctaccagataatgaaatgtcttacaacacagtgtatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaat

SEQ ID NO: 5940 - DNA, 2116 bp, Homo sapiens
catatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgatatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatc

SEQ ID NO: 5941 - DNA, 6878 bp, Homo sapiens
gggtcggaggagacgccagccaaagtaggcggagttgcggaaggagagtccgatctgcgcaatccagtccgggacttggctccgcccgggagcggcggcctctccggtgacagaggagtagtgagcggcacggggtgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcacccctgccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgatatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaa

SEQ ID NO: 5942 - DNA, 1678 bp, Homo sapiens
aattgaagggaggaggacccttaggaaggaaagaaaaagagaatgtacttttcaggctaaggtttctgggttttaaaaccatcacttcagaaatcaaaatattttagcagaaaaacccccatgagaaagcttcaaggtctcggctgtgacaaagacaacatttcagtagaagtttaaggttgcgtgttgtgggcttgggaaggggtagagatctttatttcctttcattctaattctgtgccactgatacctgccagtaaaatacatgaaacatattccagaaagagttgatttagtagatgaaaaatgcgtctcccgagaccagagaaggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacaca

SEQ ID NO: 5943 - DNA, 538 bp, Homo sapiens
aacaaataaggcaggaatgggctgtatctgctgttgaccatctcaacgcccaagcctgcctttcctggcttagggaggaggccctgttggggaactgagctttctccatagccagagatttttggttccagggcttcttgacatgaaactcccaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataag

SEQ ID NO: 5944 - DNA, 3292 bp, Homo sapiens
aatgcgttactgtgtggactgagttcccatgactcgggctccccaggacaatgtctctttcttcaccaagctgatggtaaatatctggttagcttcatctatttaaaaccagccaagcaggaatcctagtgctggagagaggattctttttttttttgtttggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgatatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataa

SEQ ID NO: 5945 - DNA, 3640 bp, Homo sapiens
tatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagatgtgaacctcagaaatgtaaaaacaaaaagtctagaataaagcattccttgaattttaaatgaacatgcttttagcagctggatacgaagcagactattttcaacaaattgaatgtttcccacttgtgtgagagccaaacaagtgccatacagaaagggacctcttcaatgttaccaaagctttgtggcagcatttaagtgtggtggctccatagaagtcactatagcatggacgagccacttggcttgctttttcctgctaatcaaagttttaagaagataaaaagctatctttgttatatatgttttgtctaatttgcaatattacagtctcctggggggaaatccaacttccaataataattgtaaaaaaaaaaaaagaatgcactgtacttattcttttaatctgtctttctagaggccaatattttatttatcatgtgcatggtgatcatacttcaaggctggagcttttggagttgttgtgagtctgccctactttccaccaaaggcaccaattatacatgcacagtagttgcccttgtatcttttaaaaattgttcaagaggttgttctgtgtaagccaataactccacttgaaaatcacgaggaggtcatattttatttctgccagagagaacaggtatcattgtgccagcttggatcaaagcacctgatacaatctgtatttaaccttgtggaatgatggagggagagcttacaaacgaattcacaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatc

SEQ ID NO: 5946 - DNA, 563 bp, Homo sapiens
gactcgggctccccaggacaatgtctctttcttcaccaagctgatgggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcag

SEQ ID NO: 5947 - DNA, 2087 bp, Homo sapiens
ccgcaggcgtcacctcctcctgtcgcctggccctcgccatgcagaccccgcgagcgtcccctccccgcccggccctgctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggagccgacgctggggcttccagaaggcccgggggtctccgaggtgccggttaggagtttga

SEQ ID NO: 5948 - DNA, 3718 bp, Homo sapiens
ccgcaggcgtcacctcctcctgtcgcctggccctcgccatgcagaccccgcgagcgtcccctccccgcccggccctgctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaaccaccggc

SEQ ID NO: 5949 - DNA, 5262 bp, Homo sapiens
cgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagcaagtaccccgggcagggaaggggctgcggggaggcggggagggagcaggagggcgcggccggcggggggcaagcttctgaagcgctaggggaccagggaggtgtcggcgcccggtgtgcctggctgacggagagggtcaacgaaattggggtgcagggaggaaggagggacagtggccgagccccgtaactgtactggtgagagcagagtctgggcacctcgttcaattgggctttcgtcgagtcgcatcccgctggactgggaagcgcgaaaagggattatttgaggcgcgctccgtagagagcgtggaaaacctggccccttgctttcccagcaaggaaactagggctccgagacccacggagaactagaccctcctgacgcccctgaagggatgggaagagggacgcatcgttccggactttgtgtcacgggtgctcctctgtccttgtgcaagccggaatctgagcaccctctgaagggttggctcgtgcaaagaggcggcgaatggggccctcgagcaacatcggtcccagcgcctatctccttccttcagcccgctcggcccggggctttgttagactgaggtctcccaaggaggacatccgagctggcaactgcctcctgagcccacggtccccactgagcgccggcctcaggcccgccctcgtcggttctcagcctctggccctgtttccctggcctgggagacccgcctccgctccccaacccccgctcctatcccctcttcgtctgcgcctgcaggcccctccagcccctcctctcgctaacgtggctctgggacccggtcccggcccagactctgctaccggcccctcctcggagccccggatccggtgagggggagacaggtcgagcccctggccctaggcccacctcttttcgaggctttagacacctggattgtcctggttgggggttgggtgggaaggagggtaggtgctgagtgtggggctaagagctaagagtgggggaaatggcttggagaaaggaaagctccggttccacaggctccttggcgcgaccctgctccctctgaggaaggtggactggggcgggcgaccagcccaaaggcttcctgctattgtccccagcccagtctccccttctccatcccttccacagctctcctagactctggctgtgaccccagccattccccagaggtggcttcggggccaggagagagaagggctgtttcctcttcccagcaacgggaggatctggaaaggggagagtcggccaggtctctcccatgtgcttcagatggggtgtgtgaagcagctcggattcttccagggcagagtgatcttttctccaggccaggagttgaggagctgaccagatgctgcttcccagaaacagctacaagaagccctcttaaaggtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgtta

SEQ ID NO: 5950 - DNA, 3697 bp, Homo sapiens
cgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatgtgcttccgggtcctggcccttcccctgggacccccagtcctcccagtgatgcccacccccggccccagtcttccactcttggagttcacactcggggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaa

SEQ ID NO: 5951 - DNA, 3817 bp, Homo sapiens
cgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatgtgcttccgggtcctggcccttcccctgggacccccagtcctcccagtgatgcccacccccggccccagtcttccactcttggagttcacactcggggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaa

SEQ ID NO: 5952 - DNA, 3892 bp, Homo sapiens
gttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaa

SEQ ID NO: 5953 - DNA, 1918 bp, Homo sapiens
cccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggcc

SEQ ID NO: 5954 - DNA, 6099 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 5955 - DNA, 5931 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 5956 - DNA, 5906 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatt

SEQ ID NO: 5957 - DNA, 5913 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 5958 - DNA, 2318 bp, Homo sapiens
atccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccatt

SEQ ID NO: 5959 - DNA, 5874 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 5960 - DNA, 5967 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatgaaattttgcctacttcaactacaccagattacaaaatatttggcggtccaacatctggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatt

SEQ ID NO: 5961 - DNA, 6039 bp, Homo sapiens
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatt

SEQ ID NO: 5962 - DNA, 3754 bp, Homo sapiens
cgtccgtgcccgggggtgggacccgcgccgggagctgccgagtgcgtggagggagccaggctccggctcgcctgatggattgacttggagatggatcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcag

SEQ ID NO: 5963 - DNA, 5712 bp, Homo sapiens
caggatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatt

SEQ ID NO: 5964 - DNA, 6028 bp, Homo sapiens
gtaaccggtggaagtgtcaaagaggaaggagtggagggctgctgaggtgacagggtgtggtctgtgagggagcggacgaacccggagaagagagcagagagacccaccaggactaggaggcagcggggagcgtgcctgcgtcgctcggagcggtgacagcaaggagcgcagcgcggaggccgggcggcaaggggagtttccagtcctcgataagtggagtccctgctctgcgctgcgccagcgccttccgcctgggcccgcggtgctagacacctgccgagtccgaagcgggagtcaggctgagccttcggcccccaagatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatta

SEQ ID NO: 5965 - DNA, 4419 bp, Homo sapiens
atcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaa

SEQ ID NO: 5966 - DNA, 545 bp, Homo sapiens
gcatgctaacattcatggaggcagacatgtgtacccagaatcagagggagccggttatcctcagttggagatcccaaaagacttctgcatacagttcctttcgttggatggagacactgtaagaaccacggagtgttaaacttggggcttgggaatcagagtccatccttgaatttcacaaaagaaacgaccgaaatcaaaagaaggcaagatacagctgttcgcatttgcagacctgtatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagc

SEQ ID NO: 5967 - DNA, 734 bp, Homo sapiens
ccaaactgcttctgttttccaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaag

SEQ ID NO: 5968 - DNA, 479 bp, Homo sapiens
aggactgggtttggagagctgctggatagctgaacacgtggaggttcctggaaggcggcacacccagagagagcatggtagctccatgctgcttcccccatacctcaccctacacatctcttcatctgtatcctttataataatccactaaatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggaacttccaatcctgctttagaacttactccttcaggaaagcaactctcactgaagtgtgggagcggagcagagaaaagactaggtagctcagtggcatttctgagcaggggccaccctgacttcaccttggcccaccatga

SEQ ID NO: 5969 - DNA, 588 bp, Homo sapiens
aaggcagaacttcacggaacaactgcgcccgcagctctcctgggctgcagtgatttgtcctctgggttctggaggaaagctctgaaagaagtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactac

SEQ ID NO: 5970 - DNA, 1397 bp, Homo sapiens
ctggttccctggcaggctggagggcaggagctggggccacgctggtctgggatagttgggcagggagacggagtctcgatctgtcacccaggctggagtgcagtggcacaaccttggctcactgcaacctccgcctcccaggttcaagtgattctcctgcctcagccttctgagtagctggaattacaagctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 5971 - DNA, 1449 bp, Homo sapiens
ggtgcatgagtcataggcagtgcccgggaaagcggtgagggttgctctcatcccctctcctcctccgtcttcacccggaggcttagggtctggagctttctctttaacaaaggaggagggaccaaggttgccggaagctgcctgaagctggacagagccggttcctggaaagagctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 5972 - DNA, 544 bp, Homo sapiens
tggtctgggatagttgggcagggaggtaaggggtctggggccagctggggcccctggggctcagtgtgtgtgtgaatgagaggctgatgagaggctgcaggagtttgggaggctttgggcaaagtccaagctgagcaggtgggagtgagagggcctgagcgtgttctaggccctcctgggaatgtcgattgaattcagggtgccctgcagaagaaagtgttgtgctggggaccctgaagggcgagagtgggttctgcctgccagaggggcagggttgggcattctgccagccaaggggccagcccgaggtgtcccagccctggcaccagggatttggctgtggagtgccaccaaggtggcctctggggaaaggctttggggacaagtgaggtggacagcactggtggtccttacctcaactcatagatgtgacaggctgtctacctggtctccagaatggacggccctgtggcagagcatgccaagcaggagccctttcacgtggtcacacctctgttggagagctgggcgctgtcccaggtgg

SEQ ID NO: 5973 - DNA, 3128 bp, Homo sapiens
aatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaaatacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagagaaagtg

SEQ ID NO: 5974 - DNA, 3382 bp, Homo sapiens
tcaattgtatcaacttgtttaattcagttatgggaatgtttattatgcaccaggcattctattagctgctaggcacataaacatgacaaaacgtgatcactaccaaaaagatgttaccttccataggaagtatgtatgtccaagttctcaaatctcaaaatcaaattaatttcagagtgtgtcatctttaaacgaaagaaaaaccatttttaagattcctctcctttagcactgagccttgtggagccttgaccttgtgagacctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaaatacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagag

SEQ ID NO: 5975 - DNA, 1997 bp, Homo sapiens
cgagcgccgccggaaagcgtcgagcggcttcggtaggtggggcggggccggggcggggccggggccggggaggggccaggcccggcacccggatcccgaggtccgcgccccgcgcccggcgccgggcgcccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacca

SEQ ID NO: 5976 - DNA, 2146 bp, Homo sapiens
tactttagcctttgctctgaaatcccatgcacgctttgtgaggaaggacagccttggttggggggtgtttatggggagagcagagtggatggtgcgtatgtgaatacctctccccagatgctcccccaatcccaagctctcattatcttatatgcatattcataagggatggccctgctctgtaaatgggtcagaagcaggaaatagaggccagtacagacagcgaagcccaagggataggagggctcaaagccggcacacatctgagtcctcatggacgggaggatgatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacc

SEQ ID NO: 5977 - DNA, 2056 bp, Homo sapiens
gtatttgtctggttcctgtctgtgtccgtcgttcgtccgactgtctttgtccgtctgctgtcttctgtccgtctgcccgtccgcccgtccgtccctcagtctctctgcggtccctttaccgtcctcagtctggctcgcgctgcctctcaggcacttccccagctcgccccggatcatctgggccccagcgcggagactgggatgggagcggagggagccccggactttcttagctgccctcgagtgaggcgggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgt

SEQ ID NO: 5978 - DNA, 1955 bp, Homo sapiens
gtgcttttgggggtgcaagagacagagctactctggccccatgcaggaggttcaaatctgggagtaaaggctgatgggctggccaggacaccaagaaatgaagctctttatccatgtcctcacttcatctcctcagtagtcccctcagatagctggggtaaaaaaacttatctttattttacagatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgt

SEQ ID NO: 5979 - DNA, 2217 bp, Homo sapiens
ccgggtgctcagccccaacacagtggcagtccaatgggctgaggacagaagcaactgctgctctcatctgccttccatctggtggacctaagcctaatccctgggacaaggatggtgggtgccaaggccggccccagccccggcacctccctgggcctggcacagcagcacagcggaggcagcagtgtcctagtgaaaagtcccttctgtcagcaagtctccacctcgctgccttgcatctgctctactcccaggtgtgctgctgtgggcctgctccttgtgccagctgctgccactctaggtggccctctctcaccgcatccacttgcagccgcctgttctacatcctcctccatgtgggggcctcagcaatctgctgcctcctgctgtcaaggacagtagtggaaagggtgtggggcaagacacacaggatccagatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactgagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtgggg

SEQ ID NO: 5980 - DNA, 2630 bp, Homo sapiens
gagagaacagcctgagtggccgcagtgttgaggccctaaggacaaagctccttcacagggcatttgcatttaccgcaacctggaggtcagtgttctcttccggacgtctccattctgcccgggaccgggtgctcagccccaacacagtggcagtccaatgggctgaggacagaagcaactgctgctctcatctgccttccatctggtggacctaagcctaatccctgggacaaggatggtgggtgccaaggccggccccagccccggcacctccctgggcctggcacagcagcacagcggaggcagcagtgtcctagtgaaaagtcccttctgtcaggtgtgctgctgtgggcctgctccttgtgccagctgctgccactctaggtggccctctctcaccgcatccacttgcagccgcctgttctacatcctcctccatgtgggggcctcagcaatctgctgcctcctgctgtcaaggacagtagtggaaagggtgtggggcaagacacacaggatccagatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactggcagacaggtgcagctcaagactgtagctggttcctggctgtcctgctggccaccctaggattctacagcatggcaggtgtgggagctgtgctcctattccactattatacacacccagctggctgcctgcttaacaagatgctcctcagtctgcacctttgcttctgtggcctcatctccttcctctccatcgctccttgcatccgcctcaagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctctactgcatatccggagtacttgtttggttgtcattgtataataaaggcttcttctgtgatgtttcactta

SEQ ID NO: 5981 - DNA, 2335 bp, Homo sapiens
ccgggtgctcagccccaacacagtggcagtccaatgggctgaggacagaagcaactgctgctctcatctgccttccatctggtggacctaagcctaatccctgggacaaggatggtgggtgccaaggccggccccagccccggcacctccctgggcctggcacagcagcacagcggaggcagcagtgtcctagtgaaaagtcccttctgtcagcaagtctccacctcgctgccttgcatctgctctactcccaggtgtgctgctgtgggcctgctccttgtgccagctgctgccactctaggtggccctctctcaccgcatccacttgcagccgcctgttctacatcctcctccatgtgggggcctcagcaatctgctgcctcctgctgtcaaggacagtagtggaaagggtgtggggcaagacacacaggatccagatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactgagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctctactgcatatccggagtacttgtttggttgtcattgtataataaaggcttcttctgtgatgtttcactta

SEQ ID NO: 5982 - DNA, 1774 bp, Homo sapiens
acaggttcttgctgtgttgaccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaccatgtaagaagtgcctttcacctcctgccatgattctgaggcctccccagccatgtggaactctgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcg

SEQ ID NO: 5983 - DNA, 1928 bp, Homo sapiens
acccaggcctcggcgcctaggcgcttcgccgaggctgatcttcgttcaagtgtgagctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaccatgtaagaagtgcctttcacctcctgccatgattctgaggcctccccagccatgtggaactctgagaaacctgaacggactccatttggctccttcatttgcaagacatcaagggctccttacccacccccttcctcaaggaattaacttgtgcaagctgactcccagcacatcaaagaatgcaattaactgataacatgctgtggcaagctatgtccgcagttcccaggaatttgtccagttgatattaccctaagcccctgtgtttttgtctggttgatagcacccaaagcccagcgtctatcaccttgtgatggatttaaagcccctgcacctggaactgtttgctttcctgtaaccatttgtctttttaacttcttttgcctgttttacttctgtaagactgctacagctaggctccccctcccctctctaaaccaaagtataaaacaaaatctagccccttcttcagggccgagagaattttgagcactagccgtctctcggtcgctggctaataaaggactcctcaattcg

SEQ ID NO: 5984 - DNA, 1573 bp, Homo sapiens
agctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaatggagtcccactctgttgcccaggctggagtacagtggcatgatcttggctcactgcaacctccacctcccagatgtcaagcgattctcttgcctcagcctcccaagtagctggggttacaggcatgtgccaccatgaagtgcctttcacctcctgccatgattctgaggcctccccagccatgtggaactctgagaaacctgaacggactccatttggctccttcatttgcaagacatcaag

SEQ ID NO: 5985 - DNA, 1583 bp, Homo sapiens
gtttttacccaggcctcggcgcctaggcgcttcgccgaggctgatcttcgttcaagtgtgagctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggctttgtgggcctacagcct

SEQ ID NO: 5986 - DNA, 2777 bp, Homo sapiens
gggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaagtgagtcacatgaagttttttggttttcccctgcatataaaagttacatttacaccatcctgtagtctattaagtgtgcagtagcattatggctaaaaaaaaaaaacacccaatatacctatcttaattaaagaattatttattgctgaaaaa

SEQ ID NO: 5987 - DNA, 3103 bp, Homo sapiens
attcatcaaaagaggctttcgctcccggactcccctgggcctcgagcagaaagcgtctcggccacggagatacagaaccgggagccttcaaggtcctccgccactctcagcaagccctgctctcgatggagaggagatcgctgggtgatggatgtgggcttccagggaaggtgctcgcgctggtcccgagccctccggggaagatattcgagcgcggagcgtaagcgcagggcacgccagccccgggagccgcgggagcaggcgccgcgcgtctctgcaccaccgggccgcctcccagccttctttccccagtttgccctcctgccgcagtccgggccgagattaattctctgcacttgtgagtgggcacacacaagttctccgggcacgatcctttcatctatttccctgggggagtccacctttttaacgattaacctcctagctaccgcgggcaaggtggcaggatgcgagtggggcggggaggggcgtttcacacgttcagaggcaccaaaattagctgccagtgctaaaaggctttgctttcttcggtttttgacaaataaatggggtgggatgcttgcttggccgcccgctgccccagcccgagccctgggctcacttagcagcctgatgccgagtttcagacgcagtcctgctgcgcttacacccgggcttcttcgcccccttgccaaagtctgcagcccgatggatgctgggcgcgggctttccctgagcgctttaacgcagcttaggctaaagccccagagctcccaccttctacctcctgtttatccgcccgcccctctaccaccgccaaaggacgtgccccttcagtagagtcggggatcccagccccagagcgggggagggcgcctccctatcccctcctccccgtccccgcctcggctcggggttttactgcagcagccggaggtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggagtgttgcagcaggcattctcttctggaaggagtcgctgggagcagtgcggttggacacaagtttgcgtaggagtgttttccttttgtcaataattaatcaccggaattagccaggtagaatttgagttttagcaagagtcctgagggcggggccgaacacctaactccgggaggctcccaggcgcccggcgcagtgggaagctcgcagcagctggggaggagccaaagcctcggcgctcacctaagccgcagggagatacacccaactgggagatgaggaaacagcaacccagagaggagaactaacccacacaggatcatttcgtgaaggagcaaggctgaagaaccagacctggactttcttaggacaaacttactgcagcttgaaggagccaaccatggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattgatcctgttcacattcagtgaaatggcattgcatatttatatgttgcttacagcttattgatttaggtaactattgtgtcttccttcactatctgacctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagactcctaacagacctaccagaatcatgcttaaagtgctcccttgacacttattctatactaaaggataaattttaaaaaatctttataggctactgtcagaagtatcctatccttgtttacgatgtataaaaagatgtgaataaattatatggaccccctaagtcttattttctagtaaactgatgatactggaaattcttttacttcaaatgcaaaagaataagctggaggcaattatttcctttcatacagagttcatgaattgttttaaatgcttcttaaagtctggctttataaccgtttaaaatcaacaatgttgattttagataaccaagtaagtattataatacaaaataattttaagtgtaagaaactaaagtataatcaaagtaaattcagttattgtatttgtggtgttgccttgccttgcatgatgctgggggaaaaagagaaaagaaatggttttctttttgtactttcattcagtgtagagggaaaaaagcatgtattgggccaccggaagacaagctaataaataggctggaagtaatattctaccagcaggaactcaacagctccagttaaatgctttgatatagtggctcctttgcagagccaaaacaagatttattaaatttccttcaaactgtttatctttaaaacaaatataaggttttaattatactgctgaagcaaatgtgaatgccaaagactacgttttgcagttttgctttcctcccaataaatattaatgtatgtaattctagagggtaaaaatgtaaataggtttggacaatatttgcacccttgtttgtgttatgaaaaaaatttttccaaggtgagctagagagaaagatgtttggcatgccaaattaacttgcatgtttgttaaaaaaacaaacacatgttttgaagagaaaccagatctgaacatgtatttgttgagttttgcaaaataaaattaattttgtaagtaaatatcta

SEQ ID NO: 5988 - DNA, 880 bp, Homo sapiens
agcagctggggaggagccaaagcctcggcgctcacctaagccgcagggagatacacccaactgggagatgaggaaacagcaacccagagaggagaactaacccacacaggatcatttcgtgaaggagcaaggctgaagaaccagacctggactttcttagtgctcattcctgggccctcgatcactgcatgtttgttacatggtccagtttgctgcttcctggaagagcatctcctgactgtgatgcctttgagaataaagtctttccgaagccattaatattcagaaggagccacatggacaaacttactgcagcttgaaggagccaaccatggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattgatcctgttcacattcagtgaaatggcattgcatatttatatgttgcttacagcttattgatttaggtaactattgtgtcttccttcactatctgacctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagac

SEQ ID NO: 5989 - DNA, 1673 bp, Homo sapiens
agcactgcttccggtcggtggcgcttctctctggcccgagccaggtcagtccggcagtgcagatggcccatcccgggctctgggctcctagaccggggtgggccctgccaggagtgggcctgagcctcgcacgtcctctgaaactacgctatgctctgcttttgcggcgcgatgggcgtgggagcgggggctgcccaaagatgggctggggttggaggaagtggcccggtagccgctgtgtgtcctgaggccgtaaggcgcctgaccccacccctgaagctggcgacggagcagggcctgttttctctacactatagtcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaa

SEQ ID NO: 5990 - DNA, 2868 bp, Homo sapiens
acgccggcgcggactgatgatgtcagcactgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagatcttagtctcagtgttcctggagtgagagaagaggtgcaaggggcccaaagtcaggttgccatttcaggcgaactgcctgggaaggaggaatggtgcagagtcggcaatggtgtgacttcattctacaggaggttggttagcagtggacagttctagcttgtcttagatcaaaacttaaagctgcttgggctcaagctggcatctgcctgtgtcaagaactagggccccctaaaaacactcaactagttctttccttccttcactcctggggtgagtagcttagtcaaagctgcctagccggtttgctaggcaagggcctctgggtggagacacctgaggaagctttgagacaggtagattacaggtctcccatcctcagcctaggggcgaggggagtggaggtggcagcggcagctgttttggcctgtgtctccctgatcgttcaagctcatacatggttaatgattaatgaggcagtgtggtgtggcagtatccagctgccacttcctgcctactctgctgagtaaacaggggccctgtcttagctgggcttcaaacctgttccctagggaagggctctgttccctgaatcaccagggaggaaaggcaagggcagggttggcatctcctgctcttttgtgatccaagcctcctcccccgaaccatgtctaccccacagtatgacatcagcatggggcctggggctcctgttagcaaagttgaagctttccccagggccctagcaggagtctcccactagctagcacagaggctgaggccagaaagaaatcacaaacagaggggagatgacctgacttttaatggcacagccccagctccagcaaagcagcaagacaggaagctatgcaaagctgctcagaggtgcagtggcacaaacaactctaggagatcgcctgtgttccctcccatcccccaagcttatgacgtggctccatgcccaggaactctgggccagcccagccccactcccaaaccctcataatgcacagaggagcctgggccaagccttgcttccagagttggtaaatgtagaggcagcaggaagaacagggtagcagtctaactttcaaagacagaaaccactggattatactcctacttggaaaggagctgaagactcatccttcaacagtttgtgcctggattttggtcctcatttcctccctatactgagtaaccctaggacttcaatttaaagtccctggggttatgcttcctgggcctggcaagaacccctttgcaggtctcaccttcagcgatggaagggataagggtcatgaacagcaaacagagcagcagcagcatgaaggggaaggcagcagaagctcaagcactcagagggaacaagaaaccgtgcaaggaaactgtttatttcgaaaggattttgcaataaacatagtgaataggc

SEQ ID NO: 5991 - DNA, 2995 bp, Homo sapiens
ggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccacttaaggagacatccgtggaaaactttctgggagctaccacacctgccctggctaagctgcaggtgccgcgggagcaactctctgaagttctggagcagatttgcagtggtagctgtgggcccatctttcgagccaatatgaacactggggacccttctaagcccaagagtgttattctcaaggctttaaaagaaccagctgggctccatgaggtacaagatttcttagggcgaatccaattccatcaatacctggggaaacacaaaaacctggtgcagctggaaggctgctgcactgaaaagctgccactctatatggtgttggaggatgtggcccagggggacctgctcagctttctctggacctgtcggcgggatgtgatgactatggatggtcttctctatgatctcacagaaaaacaagtatatcacatcggaaagcaggtccttttggcgctggaattcctgcaggagaagcatttgttccatggggatgtggcagccaggaatattctgatgcaaagtgatctcactgctaagctctgtggattaggcctggcttatgaagtttacacccgaggggccatctcctctactcaaaccatacctctcaagtggcttgccccagaacggcttctcctgagacctgctagcatcagagcagatgtctggtcttttgggatcctgctctatgagatggtgactctaggagcaccaccgtatcctgaagtccctcctaccagcatcctagagcatctccaaagaaggaaaatcatgaagagacccagtagctgcacacataccatgtacagtatcatgaagtcctgctggcgctggcgtgaggctgaccgcccctcacctagagagctgcgcttgcgcctagaagctgccattaaaactgcagatgacgaggctgtgttacaagtaccagagttggtggtacctgaactgtatgcagctgtggccggcatcagagtggagagcctcttctacaactatagcatgctttgaagagtctcgggcaagaaacattcatgcatgagtatatgttcttggaatcaattcctctaagaacagagaatggtctttcccagggacacaaagggagaaatgggacatggattcttgatcttcctttacacatttctcgggaaatctgaaatgatgctggatgggactctacacatcctgagctaagacatactgtcagtctcacttctgctgtcccagtcctagaaatcctgggtagaagtggtggacctgtgcaaaggaggttttagaactctgcagtatttgttggggcatggcacaaataagctcatccctcccgtccgaggctagtttcctctggaaccacatttttatctagatgaaaatttggaatgaaatgaaggaatagaaatccaataaaagagttgaagggaaagaaaatttaaggttcttcttgctcaggattacagatatggaccaacacctccttcaagaaaaggtggtaggacacaaagttcttcagtcctgagccctacatgtggggttggaggagaactataacggaaaaacctctgagtttcaccttaggtatagataaaagaaagatggtccccttttatctgattctgagacaggtaaattctgtttgttactacgtttaattagaaggtggaggagtcatttcatgattaagaacattcaacatgtattgttcattaagctagcttcctagttccgattagactaaggagactaagcctagagagtcaatgttagaacagtgaaaagaattctgtgtgtgtgtgtgtgtgtgtgcacaataaataggaaatgtagaaaccaagcaagaaggcttagtagctcagtctttaacaagggctagaaaagaatgtaatctgatatggaaggatagcagcttctaattttcaatcatctgttgatatactgtgaaacttattttattaaattaatatttattaaatggaaatatgcttttctggtttataactactaaaaatatcatagggaggataaaagtaaataagtgaaagttaatgccaatagaaaaattcaagagataatgtacaatgtcagaaaagggattctttatgtgtaaatggggataatacctatttcacaaggttgttctgaggattgatacgttttgagtatgtatttgtacactatctggcacatatgcgctcaataaacgtgtttctcctttt

SEQ ID NO: 5992 - DNA, 520 bp, Homo sapiens
gtcattatttcccctccgactgggccggtgccatcggaaaccggagtgaccagaggagggacacggaatctctggagacaggtaaaaatagaagcaagaaaaactgatagccctcagatttcataatttgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggtaaagctc

SEQ ID NO: 5993 - DNA, 586 bp, Homo sapiens
attcctggagagggggccatcaggagagggggaagggaaagaatgaggttacaggaattacttgtcagaggactgcatagcctttcagaccatggaatcgttgctttcagcttcggcttcctcatctgcaaagcataaatacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtg

SEQ ID NO: 5994 - DNA, 543 bp, Homo sapiens
atcgtgactccgttttcacctggactggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttct

SEQ ID NO: 5995 - DNA, 582 bp, Homo sapiens
accttgccctacccaaccctgtcattatttcccctccgactgggccggtgccatcggaaaccggagtgaccagaggagggacacgagacagggtcttgctgaagaccctggctaaccaggctggcctggaactcctggcctcaagtgatcctcatgccttcatcttccaaagtgctgggattacagaagtcagccacggaggtcagctgacagctaattcttaacaattgacatggtcagagcaaatcgaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccactta

SEQ ID NO: 5996 - DNA, 3207 bp, Homo sapiens
gagactagggggcggtgaggagtgggacccgctcgcggccattggttgtgcggccaggaggggcggagggacgacgcgcgggctgtgcggggccggcagcccggatccactcccgctgcgcctgctgtccgccgtgcgcccagactgcgcgccgcgccgctgcgcccaacattcccgaggacggcttcgcgggcgcgtatcgtccagaccggagcaccgccccaccgctagcgcaggagacctgccggggaagtcgcgtgtcctgacctgcagtctcaatgcacatctgatacctgctgcctttgagaaacaagttttgttgtgctgatttaacagcctgtgaattctgcaaacacgatcgtgaaaaaatgccaatctgtcctgtgtaagccctgtgtgaagttttgactttaatctaccagatcactccttcaccctccataaagatgtctgaacctgacacttcctcaggattttcgggaagtgtggagaatggaacttttcttgagctgtttcccacatccctgtccacgtcagtggacccatcctcaggccacctgtcaaacgtctacatctatgtgtccatattcctcagccttttagcgtttctgcttctgcttttaatcattgccctccagaggctcaaaaatatcatctcctccagttcctcctacccagagtatccaagcgacgctggaagttctttcaccaatttggaagtctgcagcatttcctctcagaggtccactttttcaaacctttcatcctgaggaaaatggaagagtccttgagtgtggcagcagttttgacatccccttacggaagtgtcccgtgaggcattgcctcatgaaagaaatgatccttttggtgtagacctgcttctccttctcctttttctctgatttcttttctgttcatgatgcttttcatttggggatggagacaccgatgttggtggaaatgtgtgcaaaccccaaggtgcagaatttcacacaaatggcttgatgaatctagactgggcttcttcaggtaagtcagttcattctactttgttggacgccgtaggctcatctgaggtggcctctccgtggatgctggacatggactcgcacttcatttcttttacaaagccgtgaaatcaactgagcctgcagaaactggcaaaatcaagtctgacctatgtagaagttattttccatatttaaaagataaagtggagacaccaaacttaaaaaggaagagagtcaatttagatttaatgtatgacatttctaaaactgagggtaaatatatgctaaatattttctttaacttcactttaacaagtaaaaatcacacttattgatgaatgtaagtcatttgggaaagttttggaagagtttacattttaatagcaagacaaacatgtattatgatggagcttgtgatgtatttctgcctcctggagttttattttgtttttctgcttatgttttagtcataatgccacaaagttgtggaatttttgtgattaattgctgttactagtactaagagaagcaccagaagagatgccaagaagtttttatatgaataatttctatcagtgagaattaagcatatggaaaatattcatttagttgtattttatacagtaataactcttagctgtcgtgtaagttcctttattcggtttcatagtctttataattttagtgcagaattatattaagcctccaagatgtctgatatttgttcactcacattaggttgtaaaacttagaaactaaattgcaaatatatgtgttattatatactccacgaatgttgcgtctctgataattagttgttgtatgttaacataatactctacattaggatttcaggatgtgagtttgtattaaaaattgtaggcactcaagttgtgtagctgctgggagctttagggatcctaggagctgccgtgctgcaggcagcagagtatgtctgaactcggcgggcgggtggcaggggctgtctgtgaaattaggcacacatgtgagctcagacatggaatgtggaggaactcaagctgcccctaaaaacaaaacaatcaaactgcagctccttaagagtaagaattttaatttaattttgaaaataaatggcccacagggtaaacactgaacttattcaacctacaggaggccactgcatcaacacgccacggtcttcccatggcaactgaatcattccttgttcaaaacatttaatcatcttaagcagtggggcttcaacacaccgtttggttagattgtgcagtcagcactctccagtgattagaatgggggaaagaatccactatttgtacagggtttatctttatcatactaaaatgctgagtgagtggaggtctgggaatgaaaatcagaagtcttcttcttcttttaattcataagcctcacttaaatcagaacacatttaactatttatatatcaaaaacgtccccaaacaccataagaccagcacagagttgctgccctaaaatgtataattagtgaaaaatttacctctgcttccatttaaagcatggcagtgggttgggtgtcattatgtagtataaaaactggactagataaactgctattttagagcattattagcattctctgaatatatgtatatatacatatatatacgcacacacacacacacacataaatatatatatatatatatatatataaactcacatactcccaattaaaagtcgtgtgaaagctacacaggattacagaggcatctatattatcacttttgctctttgactaatcctatgctgtttttgttatagagagaaacaaggacatggatgaagtgatttttttttaaataaaaggacaaatttgccacacaacagaacaatctgagtatgatctgtcctcagggtatctttatatcctttccatgtgaaagagatataaagaattctgacagcaaaactactttaaaaatcaaatcaaatcaaatccacaagcacactcccattcctcccctgccgcaatggttcttgctctcaatgtttagtagagaaattaagagccacattcaaagatggaaaataagatttgtcattagaagcttgccaaggtaacagattgtacaacttgagatgaattcatgttgtttaagaagttcagaaaggttggaagatgggtttataaataaagaagtggagtccattgaaa

SEQ ID NO: 5997 - DNA, 2103 bp, Homo sapiens
tctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcac

SEQ ID NO: 5998 - DNA, 1621 bp, Homo sapiens
gctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtt

SEQ ID NO: 5999 - DNA, 6676 bp, Homo sapiens
gaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctgattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgatacatatttgaactggaccatagtaattaaatgatttatcaatatcatttgcaagataattgtcaggttgagttaatagtaagtggcagcttcccagaaatttgggttatttggcctaagctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgggggtgtgtgtgtgtgtgtgtgtgtgtgtgtgtgtgtccgtgtccctgagttaagaatggtttttaggcttgtataggattaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatagcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatctttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaa

SEQ ID NO: 6000 - DNA, 3482 bp, Homo sapiens
atcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcat

SEQ ID NO: 6001 - DNA, 813 bp, Homo sapiens
atgttctttagtcttcatagagagactccaaaagaaggcatgtttggtgctaatctcaccaccttccatcccactctattcattctccttggcatcccaggactggagcaataccacatctggctttccattcctttctaccttatgtacatcactgcagtcttgggaaatggagccctcatcctagttgtcctcagtgaacacaccctccatgtcttcctatccatgctggctggcactgatatcctgctatccaccaccactgtgcctaaggccttggcgatcttctgggtccacgctggggagatagcctttgatgcctgcattactcagatgtttttcattcatgttgcctttgtggctgagtcaggaatcctgctggccatggcatttgacagttatgtagccatttgtactcccttgagatacactaccatcttaacttctatggtaaatggaaaaatgaccctgacaatctggggacaaagcattgggacaatttttcctgtcatattcctgctgaagaggctgccatactgtcagaccaatatcatcccccactcatactgtgagcacattggggtggcccaattggcctgtgctgacataactgtcaatatctggtatggcttttcagtgccaatggcatcggttttggtagatgttgcattcattggtttttcctacactttgatcctccaggctgtgtttagacttccttcccaggagtcccagcacaaagctcttaacacctgtggttctacattggagttgttctcctcttcttcatcccatcattttttactttcctga

SEQ ID NO: 6002 - DNA, 678 bp, Homo sapiens
atgtttgctggaatggatactttcctactggctgtgatagcctatgaccggtttgtggccatctgccacccactgcagtacatggtcatcataaacccccatctctgtggcctcctggttctggcatcttggttcatcattttctggttctccctggttcatattctactgatgaagaggctgaccttctccacaggcactgagattccgcatttcttctgtgaactggctcaggtcctcaaggtggcccgctctgatgctctcctcattaacattgtcttgtatgtggccatggcactgctgggtgtgtttcctgtagctgggatcctcttctcctactctcagattgtctcctccttaatgagaatgtcctccaccgagggcaagtacaaagccttttccacctgtggatctcacctctgtgtggtctccttgttctatggaacaggacttggggtctatctcagttctgctgtgacccattcttcccagagcagctccatggcctcagtgatgtacgccatggtcacccccatgctgaaccccttcatctacagcctgaggaacaaggatgtgaagggggccctggggagactccttagcagggcagcctcttgtctcttacggtacacaacctcagaactaagaggatgctatgggtcccttaagcaaatgtga

SEQ ID NO: 6003 - DNA, 1079 bp, Homo sapiens
gggcgggaccggacttccggctggtctgtggggtttcgggttcggggtttcctggtgggcgtcaggggcaggcaacagagtggcggccgctacggccctgtaacagggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataa

SEQ ID NO: 6004 - DNA, 1155 bp, Homo sapiens
ggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctga

SEQ ID NO: 6005 - DNA, 773 bp, Homo sapiens
gtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagc

SEQ ID NO: 6006 - DNA, 491 bp, Homo sapiens
gcctgggcggggcgcgccgcggttggcgcctgggcggctgggcggctgcctagcacccggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagttgtgttttgcacttaccctgtgttctgccttttggtggcataacaagggacttgcacttatcttctgcattttgcagtctttggcattgacgtggtacagcctttccttcataccatttgcaag

SEQ ID NO: 6007 - DNA, 2789 bp, Homo sapiens
gaacttttttaaaaattaaatttttattttgagatcactgtttgtgttcagttgtaagaaacaagagagattctgtgtaccctttacccattcctccatgttgcaaaactagcacaatatcaccgccacggtagacgcagtgaggccataagacatttccgtcagcaaaagggtcacttcttgtgcccctttagaaccacacccacccctgccttccaactattaatgctggcaggacttagccagaccgcaagggcgcctactccgaacaaggaagagggtcaggcgctgggagggcgactgcaagcggacaggcagcacctgcgaccacggtacttggggacaccacaaaagtccgcagagcaggcaccgcggcacttccgcgagcgccgcaggccctgcccctttcgccgtcgccgaccaattgccgcccgaagaccgaaccgcttcagcggagggccggaagtgagccgcagcttttcctttctgccaccgccttgtccaagatggcggacctccaccgccagctgcaggagtacctggcgcaggggaaagctggcggcccggcggccgcggagccgctgctcgccgcggagaaggcggaggagcccggggaccggccggcggaggagtggctgggccgcgcgggcttgcgctggacgtgggcgcggagccctgcggagtcggcagcggccggcctgacgtgcctcccgagcgtgacgcgcgggcagcggctggcggcgggcggcgggtgcctgctgctggctgcactgtgtttcggcctagccgcgctctacgcaccggtgttgctgctgcgcgcgcgcaagttcgcgctgctctggtcactgggctcggcgctggcgttggcgggaagcgcgctgctgcggggcggcgcggcgtgcggacgcctgctgcgctgcgaagaagcgccgtcccggcccgcgctgctctacatggcagcgctgggcgccacgctgttcgccgcgctgggccttcgcagcacgctgctcacggtgctgggcgcgggcgcgcaggtggccgcgctgctggccgcgctggttgggctgctgccctggggcggcggcaccgcgctgcgcctcgcactgggtcgcctgggccgcggcgccggcctcgccaaggtgctgcccgtgtgaggacctcgcgccctcgccgctggggaagtacgcggagccagcgccgtcggagaccgcgccggccgagctgaggactgcacgccgctgtgcggaagcccgtggcgaaggccctgccctaacagcctgcgagtctaatccgggagcggctgctgccagcggaggcgacagcagcgttgggagctcctcgatgtcagctttttgtgctggacttggcacacgctctgaaaactgagattttgtcattgaactggtgacaggatgtgagacggttattagaagttgctttcgaagtaactgtggtcttaggttcggctgagtaaagaaaaaggatttttcttcgagttagctgctcttgtgatttttctcaggctgttttgtcattttaaaatccagtggtagatgtagcttagcgacggtagttttttgttttggctatactaagacttggaaattattctctccagtgtcagcgaatccagaagggtatcagattaaacaccgaattcagccactggacttttaaaagtacttaagatggtttatctcgggttttttcttcagttaacaaaatcataaatatggtgccttataacatgaaaggaaaattagttgtgtatttcacgacgaaagcgacggaccaaaagaaatttcctgccccaagaagcatgggatccaggaaggggcgcgtagatgcttaacggtctcttcggaaatcctgcaaatagaaagataattctagatccggaatacctgtatctggtggaaaccatggatttctacaagctcgaattattcctcattgtatagcctgctttgtaaactagtttacaatttgcaggctgatcttaagatttttttatatctaattgctgctgccttcattttaggttcagcagttacttttaactaccttaatttattgccagaaggtatgagcctaacattctgatgagtccagaaaactacgttttgtcagtagcaatacactaggaagtaaaatatatttagaatttaaacattgtgtgccagtggtcctcgcgcttgactgcacatcagttacttgaagagccacacctcagatcaatgcagtcagaacctgggaagtaggtcccagacatcaggacctttttaaagctccccaagtgattctacgttccccaagtttgaggaccacttttctgtgcattggcttgcacaatttgaaagtaatgcttttcctgagctggatcccagtgttgccttaacagggtgtctgtcgtgccgcagtagagcactgctgcttcctccaaccccaaaatttatgttcctaagtaagtcaggtccctaagccccgtcccaagaagtgacacaagtggccaacatccacactgtaggcttgcaggctacccgccctgagatttggtaaagaacactgccttgttccccatcagtaaacaaggttacctacctcaggaggctgcttgtgagagagcaaatgcagtatcttcagaatgatttatttttttaattaattgtaaagacttgtgccattggctgctctttctagtcccctaaatttctgttctagttttaaatttctctagaacttgcaatagttgggggttttataatgatgttttacaatgtttatttctt

SEQ ID NO: 6008 - DNA, 6643 bp, Homo sapiens
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 6009 - DNA, 6616 bp, Homo sapiens
gtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 6010 - DNA, 4785 bp, Homo sapiens
atgcaattaatggccctggagcagaggtttgggtctgggttgccgggtgggggacagcctctgtgtctcatgatgtcttctccactccccccaccacccccccatttctcctgcctccctgccagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccccgtccacagaactcttgagcctgctggcctcttgacctctgacccctgactgtcattctctccccgggccagggactctgttcaaactgcgccctgccctcatctcccaaggcc

SEQ ID NO: 6011 - DNA, 6622 bp, Homo sapiens
ggccgcgggcgccgccgaccgggactcagcagccccgccaggcagccgcctgtgatgctgccgtcccccgtcgccccgtggccccacaatgacccacagccccgcgacaagcgaggacgaggaacgccacagtgccagcgagtgtcccgaggggggctcagagtccgacagctccccagacgggccaggtcgaggcccccgggggacccggggccagggcagtggggcacctggtagcctggcctctgttagaggcctccagggccgctcaatgtccgtcccagacgacgcccacttcagcatgatggtcttcaggattggcatcccggacctgcaccagacaaaatgccttcgcttcaaccccgatgccaccatctggacggccaagcagcaggtgctctgtgccctgagcgagagcctgcaggatgtgctcaactatggcctgttccaaccggccacctccggccgcgatgccaacttcctggaggaggagaggctgctgcgggagtacccccagtcctttgagaagggggtcccctacctggagttccgatacaagacccgagtttacaaacagaccaacctggatgagaagcagctggccaagttgcacacgaagacggggttgaagaagttcctggagtatgtgcagctcgggacatctgacaaggtggcgcggctgctggacaaggggctggaccccaattaccatgactcggattcgggagagacccccttgacactggcggcccagaccgaaggctctgtagaggtgattcgaaccctgtgcctgggcggggcccacattgacttccgggcccgggatggcatgaccgcactgcataaggccgcatgcgcccgacactgcctggcactcacggcgctcctggaccttgggggttcccccaactacaaggaccgtcgggggctgacccctctgttccacacggccatggtgggtggtgacccccgatgctgcgagctgctcctgttcaacagggcccagctgggcatagctgatgagaacggctggcaggaaatccaccaggcctgccagcggggtcactctcagcacctggagcatctgcttttctacggggctgagcctggagcccagaacgcctcggggaacacggctctgcacatctgcgccctctacaacaaggagacctgtgccaggatcctcctgtatcgaggtgccgacaaggatgtgaagaacaacaacggacagacccccttccaggtggcagtgattgctgggaattttgagctgggggagctgatccgaaaccaccgagaacaggatgtggtgcccttccaggagtcccccaagtacgcggcccggcgacgggggcccccaggcacagggctgacggtgcccccggcgctgctgcgggccaacagtgacaccagcatggcgctgcccgactggatggtgttctccgccccgggggccgcgtcctctggggcccctggccctacctcagggtcccagggccagtcgcagccctcggcccccaccaccaagctcagcagcgggaccctccgaagtgccagcagcccccggggtgccagggcccgctctccatcccgagggaggcaccctgaggacgccaagaggcagccccgaggccggcccagctccagcgggacaccccgggaagggccagccgggggcacggggggctcagggggccccgggggctccctgggcagccgcgggaggcggaggaagctctactcagcggtacccggacgctccttcatggctgtgaagtcctaccaggcccaagccgagggggagatctccctgagcaagggcgagaagatcaaagtacttagcatcggggaaggaggcttctgggaaggccaggtcaaaggtcgtgttggctggttcccctctgactgcctggaagaagtggcgaatcgctctcaggagagcaagcaagaaagccgcagtgacaaggcaaagagactcttccggcattataccgtgggctcctacgacagctttgatgccccaagcttaatggatgggattggcccagggagcgattacatcattaaggagaagacagtcttgctgcagaagaaggacagtgaggggtttgggttcgtgctccggggggccaaggcgcagacccccatcgaggagttcacccccaccccggccttcccggcgctgcagtacctggagtcggtggacgagggtggcgtggcatggcgagctggactgcgaatgggagacttcctcatcgaggtgaacgggcagaatgtggtgaaggtcggccaccgacaggtggtgaacatgatccgccaagggggcaacacgctgatggtgaaggtggtgatggtcaccaggcacccggacatggatgaggcagtgcacaagaaagcaccccagcaggccaagcggctgccgcccccaaccatctccctgcgttccaaatctatgacctcagagctggaggagatggtctccccctggaagaagaagagtgagtacgagcagcagccggcgccggtgcccagcatggagaaaaagcggaccgtgtatcagatggctctcaacaaactggacgaaatcctggccgcagctcaacagaccatcagtgcaagcgaaagccctggtcccggtggcctcgcgtccctgggcaaacaccgacccaaaggtttctttgccactgagtcgagcttcgatccccaccaccgtgcccagccaagttacgagcgtccttctttcctgcctccaggacctgggttgatgctccggcaaaaatctatcggtgcggcagaagatgacagaccttacctagcacccccagccatgaaattcagccgcagcctgtctgtgcctggttcggaggacattcccccgccacccaccacgtccccaccggagcctccctacagcacacctccagtcccctcctcctcagggcgcctcaccccctcccctcggggagggcccttcaaccctggctctggtggccccctccccgcctcctcccctgcatcctttgacgggccctcccctcccgacactcgcgtggggagccgcgagaagagcctgtaccacagtgggcccctgcccccggcccaccaccacccgccccaccaccaccaccaccacgccccgccccctcagccccaccaccaccacgcccacccccctcatcctcccgagatggagacaggcggctctcccgacgaccctccaccccgcctggctctggggccccagcccagcctgcgaggctggaggggcggcgggcccagcccgaccccgggggccccgtccccatcgcaccacggcagcgcgggcgggggcggcggctcctcccagggcccggctctacgctatttccagctgcccccgcgggcggccagcgcagccatgtacgtgcccgcccgctcgggccgcggccgcaagggcccgctggtcaagcagaccaaggtggaaggcgagccccagaagggcggcggcctcccgcccgcgccgtcgcccacgtccccggcctccccgcagccgccgcccgccgtggccgcgccctcggagaagaactccatccccatccccaccatcatcatcaaggccccgtccaccagtagcagcggccgcagcagccagggcagcagcaccgaggcggagccccccacccagccggagcccacgggaggcggcggcggcggcggctcctcgcccagccccgccccggccatgtcacccgtgcccccgtccccctcgcccgtgcccacccccgcctcgcccagcggcccggccacgctggacttcacgagccagttcggggccgccctggtgggggcggcccggagggaggggggctggcagaatgaggcgcgccggcgctccacgctgttcctgtccaccgacgcgggggacgaggacggcggggacggcgggctgggcacaggggcggccccgggcccgcggctgcgccactccaaatccatcgacgagggcatgttctccgccgagccctacctccgactggagtctgcgggcagcggcgcgggctacggcggctacggggccggtagccgagcctacgggggtggcgggggcagcagcgccttcaccagcttcctgcccccgcgacccctggtgcacccgctgaccggcaaggccctggatcccgcctccccgctggggctggccctggccgcccgcgagcgagcgctgaaggagtcctcggagggcggcggggccccccagccgcctcccaggcccccatcgccccgctacgaggccccgccgcccaccccgcaccaccactcgccccacgcccaccacgagccagtgctgcgtctctggggggcctccccgccggaccctgcgcgccgggagctggggtacagggccgggctgggcagccaggagaagtcccttcccgccagcccgcccgccgcccggcgttccctgctacaccgcctgccgcccaccgctcccggggtggggcccctcctgctgcagctggggacggagcccccggccccgcaccccggagtaagcaagccctggaggtccgcagcccccgaagaacccgagcggctgccgctgcacgtgcggttccttgaaaactgccagccccgggcccctgtgacgagcggaaggggtcccccctcggaggacgggccgggggtcccgccgcccagcccacgccggtccgtgcccccctccccgacctccccgagggccagcgaagagaacgggctgcccctgctggtcctgccgcctcccgccccctcggtggatgtggaagatggcgaattccttttcgtggaaccgctgcctccgcctctggaattctccaacagcttcgaaaagccagagtcgcccctcacgcctgggcctccccacccgctgcccgacacacctgcccctgccaccccgttaccccctgtgccacccccggctgtggccgcagcccctcccaccctggactccaccgcatccagcctgacatcctatgacagcgaggtggccaccctgacccagggggcctccgccgctcctggggacccccatccaccaggcccgcctgccccagcagcaccggctcccgctgccccacagcctggcccggaccctccgcctggcacggattctggcatcgaggaggtggacagtcggagcagcagtgaccacccactggagaccatcagcagcgcctccacgctgagcagcctatctgccgaaggtggtggcagcgcagggggtgggggcggggctggggccggtgtggccagtgggccggagcttctggacacctatgtggcctacctggacggccaggcctttgggggcagcagtactcccggcccgccataccctcctcagctcatgactccctctaagctccggggccgggcgctaggagccagcggaggcctgcggcctggccccagcgggggactccgagaccctgttacccccaccagccccaccgtctcggtgacaggggctggaaccgatgggctgctggccctgcgtgcttgttcaggaccccccacggcaggcgtggcggggggtccggtggctgtagagccagaagtcccaccggtgcccttgccgacggcctcctctctgccccggaagctgctgccctgggaggagggcccgggcccaccgccaccacctctgcccgggcccttggcccagcctcaggcctcagccttggccacagtaaaagccagcatcatcagtgaactcagctccaagcttcagcagtttgggggctcctcggcagctggcggcgctctgccctgggcccgaggaggcagtgggggaggcggagacagccaccacgggggagccagctatgtccccgagaggacctcctccctgcagcggcagagactctccgacgactcccagtcctcactcctctccaagcctgtcagcagcctgtttcagaactggcccaaaccacctctgccgccactccccaccggaacaggggtctcccctacagccgctgcggccccaggggccacctcaccctcagcctcctcctcctccacgtccacccgccacctccagggcgtggagttcgagatgcggccccctctgctccgccgggcccccagcccctcgctgctgcccgcctcggagcacaaggtcagccctgcgcccaggccctcgtccctgcccatcctgccttccggacccctctacccaggcctctttgacatccgtggctccccaactggaggggcaggaggctcggctgaccccttcgccccagtctttgtgccgccacacccggggatatccggggggctcgggggagccttgtcaggggcctcgcgctccctctcaccgacccgcctgctctcgctgcccccggacaagccgtttggcgctaaacctctggggttctggaccaagttcgacgtggctgattggctggagtggctgggtttggcggagcaccgagcccagttcctggaccacgagatcgatggctcccacctgcccgccttgaccaaggaggactacgtcgatctaggtgtgaccagggtgggccaccgcatgaacatcgaccgggctctcaaattcttcctggagaggtgatggctggcctggacggaccagccc

SEQ ID NO: 6012 - DNA, 1776 bp, Homo sapiens
gtttttcccttgggacccgggtccacacggcggggtcgcccgtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcatggtaaatatttcattacagaatttatgttagagctttcatgccaagaatgttttcttacaaaattctctttttattgaggtttcactaataagcagcttctacttttgagcctcaacttaaagcagaactgttttctactggatttttcattaacagcaagctttttcttttatgtaaaataaatctattgtgaattgata

SEQ ID NO: 6013 - DNA, 1199 bp, Homo sapiens
ctaggatgaatatcatggacttcaacgtgaagaagctggcggccgacgcaggcaccttcctcagtcgcgccgtgcagttcacagaagaaaagcttggccaggctgagaagacagaattggatgctcacttagagaacctccttagcaaagctgaatgtaccaaaatatggacagaaaaaataatgaaacaaactgaagtgttattgcagccaaatccaaatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcacaactaaactcagctcgccttgaaggagataacattatgatttgggcagaggaggtgacaaaatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatga

SEQ ID NO: 6014 - DNA, 1392 bp, Homo sapiens
gtccatctccggctcgcccgcggggcccatcgtcgacgttagcggccgttctccgagccgactgacccatccttggcgctgccgccgcgcgcttgttctcctccctcgccccgccttcatcctccccgttcacggaaacgacagctgcggctgcggggctggcgccgcctccctccacctaccacgtctgccctcgccgctctagccctgcgccccagcccggccgcggcacctccgcctcgccgccgctaggtcggccggctccgcccggctgccgcctaggatgaatatcatggacttcaacgtgaagaagctggcggccgacgcaggcaccttcctcagtcgcgccgtgcagatgccaggatagaagaatttgtttatgagaaactggatagaaaagctccaagtcgtataaacaacccagaacttttgggacaatatatgattgatgcagggactgagtttggcccaggaacagcttatggtaatgcccttattaaatgtggagaaacccaaaaaagaattggaacagcagacagagaactgattcaaacgtcagccttaaattttcttactcctttaagaaactttatagaaggagattacaaaacaattgctaaagaaaggaaactattgcaaaataagagactggatttggatgctgcaaaaacgagactaaaaaaggcaaaagctgcagaaactagaaattcatctgaacaggaattaagaataactcaaagtgaatttgatcgtcaagcagagattaccagacttctgctagagggaatcagcagtacacatgcccatcaccttcgctgtctgaatgactttgtagaagcccagatgacttactatgcacagtgttaccagtatatgttggacctccagaaacaactgggaagttttccatccaattatcttagtaacaacaatcagacttctgtgacacctgtaccatcagttttaccaaatgcgattggttcttctgccatggcttcaacaagtggcctagtaatcacctctccttccaacctcagtgaccttaaggagtgtagtggcagcagaaaggccagggttctctatgattatgatgcagcaaacagtactgaattatcacttctggcagatgaggtgatcactgtgttcagtgttgttggaatggattcagactggctaatgggggaaaggggaaaccagaagggcaaggtgccaattacctacttagaactgctcaattaagtaggtggactatggaaaggttgcccatcatgactttgtatttatatacaattaactctaaataaagcaggttaagtatcttccatgttaatgtgttaagagactgaaaataccagccatcagaaactggcctttctgccaataaagttgcat

SEQ ID NO: 6015 - DNA, 2361 bp, Homo sapiens
gggtgcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggttcgtcgcctgcagcttcgagaggagttggatcgatcttcttgtggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccagtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgcc

SEQ ID NO: 6016 - DNA, 2038 bp, Homo sapiens
gcacacccggaagtgggtgcgggccagccggctcgcccgggggccatggcagcagcggctactgcagccgagggggtccccagtcgggggcctcccggggaagtcattcatctgaatgtgggaggcaagagattcagtacctctcgccagactctcacctggatcccagactccttcttctccagtcttctgagcggacgcatctcgacgctgaaagatgagaccggagcaatcttcatcgacagggaccctacagtcttcgcccccatcctcaacttcctgcgcaccaaagagttggatcccaggggtgtccacggttccagcctcctccatgaagcccagttctatgggctcactcctctggaaacgtcctcttcaatggttacctgccgccaccagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggacaacctgaggagccggggatggtgcgcctggtgtgtggacaccataattggatcgctgtggcctatacccagtttctagtctgctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggggtctttcatctgggggtgcctgtggaggccttgttcttcgtcgggaaccagctcattgctacaagccacacagggcgcatcggggtgtggaatgccgtcaccaagcactggcaggtccaggaggtgcagcccatcaccagttatgacgcggcaggctccttcctcctcctgggctgcaacaacggctccatttactacgtggatgtgcagaagttccccttgcgcatgaaagacaacgacctccttgtcagcgagctctatcgggacccagcggaggatggggtcaccgccctcagtgtctacctcacccccaagaccatctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggcccctacggtgagcgggacgaccagcaagtgttcatccagaaggtggtgcccagtgccagccagctcttcgtgcgtctctcatctactgggcagcgggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctgcaggtggcctgacggagcaagagctgatggaacagctggaacactgtgagctggccccgccggctccttcagctccctcatggggctgtctccccagcccctcaccccgcatctccctcaccagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttca

SEQ ID NO: 6017 - DNA, 4558 bp, Homo sapiens
agaacagaaggctggggtgagggtgggagtcgggtgctaaatatttctactaggctcctgcaaggctagtgatgcagcgggccccccgaccggcgctcgcccgggttctgcgcctaagagttggccgtgagcgacccgcgccgccgggagcctgggtctaggctctcccgacaaggattccaaggcgagaacactggtgcctctgcctgggccagggagagactgaaatcagagcaggggaggcgtttcccccatgggctgtcacccttaaggggccgggagccgaggtgggcgagctcgagagcagagttggagaggtggctgctgtgagttgcatcgggcgttgaggtatctgatgtctgcaccgtttatctaccagacgacgaggcgatttatgcaacagtatcctgtttcagcactgccaaggctatgcgagaacgcggccaggacagcctggcaggactcgtgctgtatgtaggactcttcgggcaccccgggatgctgcacagggccaagtacagccgctttcggaacgagtcgatcacgtccttggacgaaggtagctccggaggctcggtcgggaacaagggctcgccgcagcctccccaccccgccctggcacctcacctgccgactgaagatgccaccttgccgtcgcaggagagccccaccccactgtgcaccttgatcccccgcatggcaagcatgaagctggccaacccggccactttgctgagtctgaaaaacttttgcctgggtaccaaagaggtgcctcggctgaagctccaggaaagccgggacccaggttccagcggcccctcttccccagaaaccagtttaagtaggtccgggactgcacctccaccgcagcaggacctggtgggacacagggcaaccgccctaacccctgattcgtgcccgcttcctggccctggggagccaacacttaggagcaggcaggacaggcactttctacagcacctgttggggatgggcatgaactactgtgtgaggtacatgggctgtgttgaagtgctgcaatcaatgagatcactggattttggaatgagaacccaagttacaagggaagcaataagtcgcctgtgtgaagctgtccccggggcaaatggagccattaaaaagcgaaagcctccagttaagttcctatcaacagtccttggcaaaagtaatcttcagttttcaggaatgaatataaaactgaccatctcaacatgcagtctcacattgatgaatcttgacaaccaacagattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcattggactgtcccatttgctggttaaaaggattggggcccaaatcctctggcctagcatttctcagtgtttgctattcagactgtctaaatacagcatgtgacaagctgaagaagccaaatctatcagtcatttctgatttcattatattctccccctcttcctgctaaaaagacaaaaaacaaaaaacaaaaaaaacaaaaaaaacctcatgagtgcatggatttaaaagagggcaaacaaaaccagtattcttcatatttactattcaaattggtttcattcttagtaaaagtacagaatctatttgaaattatagtaaaatttcttcttgattggctgacactgaatcatagtttctcacctacatatatccttagcacctcgtatagatatgatcagacaaaatgcagaaggaaaaaaaaacatattgaatgaagcacttggaaagattttccacatgtagaccaactggtaaactaacagagtgattaagcatggtgtacagaaaagcattacgctgagtcttaccagtgtgaccttcagcaagttgctgaatctgtttgggttccagtttccttggcaataaaatgagctaaatgggctaggtgaatttggaggactacttcagtcctaacttatagtatgagtctctaaaaagcaagtttttcatttgttagaggtcgttattgataaccagtctgtatagttaaggtaaaaaattaagcttttcttctatagtctgtgtccatactcacagaatgaatggcacacctgagatcaacattcacatagtttagactccaaaccattcagtctaaaatactgaaactttggaatatagggaatgatgataaaagtggatttggtttgagtagcagaaaactacttatgtccttttcttgcctttccaagaaaaatgttttttgtttttttttttaatcttgagttatctggatattgccttgactccatttcattttggctatgtagatacaacttagtctttgtgattgtgatatatttgctaagttttaaataaaacttcttttggatagaaatcattagaaaccaagcatactgcactctaatattttactgtaaaggcttatgatttttatttctactgccattaattttttagatggatttgtttcctcttacacaactagaattaatgtatttttcaccagttttccatataccttaggtcttgatcgtttgtccttaaaaaggggatcagcatgagtatagacagtagaaatgtatgggtagtctaaccacttttatcagagacagagcagggctgtggtctcactctagctgagcagagtattaacttggtagcaagagttcctgatacaaatagatgcaatgactgtaaatggtgtcagcagtacacatggataatcagtatttgactgtaatagtatagtagttaaatacagcacttaaaaataccacagacacagttaaagcaaaaggaaacaataaaaggaatgtctgcatgctattttaatctcacattctttatctgtcttaaagtggaaatccatttgcctataaatacctgtaaacgactttaaaaaataaatgattattgctttgtgacaattgaca

SEQ ID NO: 6018 - DNA, 2799 bp, Homo sapiens
tttttaaaaacatgttttacctgtttttaccttcaacttaaaagcctcaggttttaagttgtatatacttatatgaattatatgactgtgtatacttacaggattcaagcacatttcatttattctgcactttatttctattattattacattatagttatgtagaattatacaactcaccataatgtagaatcaatgggagccctgagcttgttttcctgcaactagatggtcccatctgggggtgatgagacacagtgacacccgaggtgtgttccttatgtccggtctattctgtaatctcattttggttgctgttactgtggaaaatcctgcctcacaaagataggatgttgaaaatggaaggaggcttttcagtacttttgtggcaatctcaggatgttccgccttgactttaatcgagaacgtatggagatttgaagttgtctcaaacatacttttaaggccaccgtcatttgcaatatcaagcagttgatcctcttctagcgtggacaaagtggattcacctggcttattcacaaatgggtcacagatccattccgtcttttgtggatgagaagtgtgatggttaatactgagtgtcaacttgattggattgaaggatacaagtattgatcattggtgtgtctgtgagggtgttgccaaaggagattaacatttgagtcagtgggctgcgaaaggcagacccacccttaatctggttgggcacaatctaatcagctgccagcttggctagaatataagcaggcagaaaaatgtgaaaagagagactggcctagcctcccagcctaaatctttctcctgtgttggatgcttcctgccctcgaacattggattcccaagttcttcagtttcagaactcggactggctctcctctctccttagcctgcagacagcctattgtaggaccttgtgatcatattattgcaaatcatcatatgcagtctatttcatttgcctctggaggggatcctgatactacagactatgttgcctacgtagctaaagatccagttaatcaacgagcctgtcacatattggaatgccacaatggaatggcccaagacgtcataagtaccatagggcaggcttttgaactccggtttaaacagtacttgaaaaatccttctttgaatacttcttgtgaaagtgaggaggtgcatattgatagccatgccgaggagagagaagatcatgaatattacaatgaaattccagggaagcagccaccagtaggtggtgtttcagatatgcggatcaaagttcaagccacggaacaaatggcttactgccccatacagtgtgaaaagttgtgctatttgcctggaaactccaagtgcagcagtgtatatgagaactgtttagaacaaagcagggcaataggtaatgtccatccaagaggggtgcagtcccagcgagatacctcattattgaagcacacgtgccgagtggatctctttgatgacccctgctacattaatacacaggctcttcaaagtacacctggctctgctggaaatcaaaggtcagcccaaccactggggagcccatggcactgcggaaaggcaccagaaactgttcagccgggtgccacagcccagcctgccagctcacattctttgccacacattaagcagcagctgtggagcgaagaatgctatcatggcaagctgagcaggaaggcggcagagagcctcttggtaaaggatggggactttttggttcgagagagtgcaacatcccctggccaatatgtgctgagtggactacagggaggccaagcaaaacatcttctcctggtggatcctgaaggcaaggtgaggaccaaggatcatgtatttgataatgtcggccaccttatcagataccatatggataacagtttgccaatcatctcctctggaagcgaagtaagccttaaacaaccagtgagaaaagataataatccagcacttttgcattccaacaaatgacagtattgaagcaccatcacactgatatttcaagaaaccccattttgtattaggacacaaagataatttaaactttgtttgtagataaaatagagcacaaactgtgaagtgcatctttccaagaccatcatggaccaggtcctctataaaatgaagaactaacaaaaattagtcttcagaaatgaaaatcagaaaagaggaagagggttggtcattttaaaagaaattatatgtatgcacggatgtcactttttaaggccatattgcattgataacaagctaaaagcacaactaaaatttcacatgctaacgacaacttgaatgaactgctggggcagtggtatgtgcctttcaacttgataatttgggggacattttcatattgggagattaattctaagtatcttcatgttctatgactatagaaccatttgccaaaaaaaaaagcttttcttgctacaaaaaataagcaattttcttgagccttattgactttattacattttctgtttagcagcatttttcactgcaatgttaaaataaatatgacattgaattcgaactgtgtgtatgtcagtggaatcaaatcaaaagccactaacatggctgtctgtttcattggactgtcccatttgctggttaaaaggattggggcccaaatcctctggcctagcatttctcagtgtttgctattcagactgtctaaatacagcatgtgacaagctgaagaagccaaatctatcagtcatttctgatttcattatattctccccctcttcctgctaaaaagacaaaaaacaaaaa

SEQ ID NO: 6019 - DNA, 2889 bp, Homo sapiens
aggcccgggggtcgccggggccacgacttctcggagaccgtcctgcgctctctggagacgcgctgtccgcgcccagggtggtgccatgtggggcgctcgccgctcgtccgtctcctcatcctggaacgccgcttcgctcctgcagctgctgctggctgcgctgctggcggcgggggcgagggccagcggcgagtactgccacggctggctggacgcgcagggcgtctggcgcatcggcttccagtgtcccgagcgcttcgacggcggcgacgccaccatctgctgcggcagctgcgcgttgcgctactgctgctccagcgccgaggcgcgcctggaccagggcggctgcgacaatgaccgccagcagggcgctggcgagcctggccgggcggacaaagacggccccgacggctcggcagtgcccatctacgtgccgttcctcattgttggctccgtgtttgtcgcctttatcatcttggggtccctggtggcagcctgttgctgcagatgtctccggcctaagcaggatccccagcagagccgagccccagggggtaaccgcttgatggagaccatccccatgatccccagtgccagcacctcccgggggtcgtcctcacgccagtccagcacagctgccagttccagctccagcgccaactcaggggcccgggcgcccccaacaaggtcacagaccaactgttgcttgccggaagggaccatgaacaacgtgtatgtcaacatgcccacgaatttctctgtgctgaactgtcagcaggccacccagattgtgccacatcaagggcagtatctgcatcccccatacgtggggtacacggtgcagcacgactctgtgcccatgacagctgtgccacctttcatggacggcctgcagcctggctacaggcagattcagtcccccttccctcacaccaacagtgaacagaagatgtacccagcggtgactgtataaccgagagtcactggtgggttcctttactgaagggagacgaaggcaggggtggattctcgaggtggaagtccgcacatgtcggtggtatttatggcacgattcctttggatggcttcatttgcccccagactgtatgaaaacatctccgaattagcatttctggatatgtttcatccagggtatcattgatttatgatggaaaaccggcctcagctggagatgactgtgatgttgctgatgggtgtataacaaatgcttgagtccgaagtgcccttgagatatggttgacgaaagaattttataaactgataaattaaggatttttattatgttgttattattatttcttttttgttgttgactgcacaggatcaaaatgcctgttatctcccttttacctgggactttttttttttttttttttttttttaatcagacagggtcttgctctgttgcccaggctggagtgcagtggtgcgatctcggctcactgcaacttcagcctcctggattcaggcaacactcctgcctcagcctcccacgtggctgggattacaggtgcctgcccccatggctaattttttgtattttttgtagagatggggtttcaccatgttggctgggctggtctcactctcctgacctcaagcaatctgcctgtctcagcctcccaaagtgctgggattacaggcgtgagccaccgcccccagcctgagcctttttttttttctaatgcatccaaggttaaggggaagacgcaaataacaggactattctaaaaggaaacctgtttgaactctgtgagatcagtcatcagtctcagtattccacaggcacaccttaatttcattgtaaaaagatatatatattttgtctatttttgtgcttttgggggcctattttgtgcttttttaccttatgtagagatcttattacaaagtgattttctacattaaaaagagactgaaataaattgtatagttacttaactaatgaagacatttcagaactctgggatgattttaatcttgaagtagtaggtggtatagtcataaaaccattcatccccttcttgattgtatcttaattttctggctttaaggtgacatctgagaggtaatgcattcttttttatattgaaatcataaactatcacccgctgcttctctgagttacttttaattttgccttgtggttatggtttggcgtttccttctgtttggttttcagagccccatgtctatatagtcctgagtgcaagtaattactatacttgtaaatgaagatcagtatttctgcctagatctgataaaaaaattttcttgtcttagttataaaaattcaaagaaatgtgttacaaagatacttagtatagctcctcagccataacctgagacttgggatgaaatttaaaccagatacgatttactttgcagatcataaggctttttatactcttgttatcaaaatggcttatttttcaggcactaaggattgttaagagaaaagcttttcaacgaaggattgcctttcttctcccacactgttcttgatttcctctctctttcaggcctcaacaggcactgtattcattgccaatgttccaaattatcaaattcaagtgaatttatttgtgtgttctttacttatataaaaaaagataactttaaggatgtgcaagtacatttccaactgctagcacaaccagtattttgtaattaaacaaatcgctgtatggtatggtcttctacacatttatgtctatagatatctatcgatcatctttctattctgtttcatgactgaataatgtaaaaccagtgttggcaattggtatcatcaatgatactcattttttaataaccaaaggcaggggaaaatcattttacttattaataaatattttatgatgtgaa

SEQ ID NO: 6020 - DNA, 1971 bp, Homo sapiens
cgcgcaccatgctgactcccggcctgcggaactcgtagtgcagcccctgtcgcctccccggcccctgctatcccacgcaggactggcttcggccgccggggccagcagcttgcgacgtgtccctggggaggcggaatcgctgtgcgccctgagcccgggctcagcccttcgctttccagctgcgtcctgctcccggccgcccagggagcccagtggcgatgagggcactgctggcgctttgccttctccttggctggctgcgctggggcccggcgggcgcccagcagtccggagagtactgccacggctgggtggacgtgcagggcaactaccacgagggcttccagtgcccagaggacttcgacacgctggacgctaccatctgctgcggctcctgcgcgctccgctactgttgcgccgcggccgacgccaggctggagcagggcggctgcaccaacgaccgccgcgaactggagcacccaggcatcactgcgcagcctgtctacgtcccctttctcatcgtcggctccatcttcattgcgttcatcatcctgggctctgtagtggctatttattgttgcacctgtttgagacccaaggagccctcgcagcagccaatccgcttctcactccgcagctatcagacagagaccctgcccatgatcctgacctccaccagccccagggcaccctcccggcagtccagcacagccacgagctccagctccacaggcggctccatccgcaggttctcctttgccagggctgagccgggctgcctggtgccctcaccgcccccgccatacaccaccagccactcaatccacctggctcagccatctggtttcctggtgtcaccccagtatttcgcttaccccctccagcaggagcccccactgcctgggaagagctgtccagacttcagttccagttgacacgcccaggccatgaatccacaactcagtcagatggcagacaggtggagccctgctcccattgccacatgcaattctgagaaaatttcccttgtaactgatcagtgtcatggaggagcatgctaggaaaacacagcaccttctaatttgaaagttcctgtctccaatcacagaaaggctaaaccagagaactgttttctggttttgcaaacatgtgatcattacatttcaatctatgctacttttattcaaaatatgcagcagtttgactttaaagttgcaaactggctaaaaacgttttactggacattcagctatattgcttagaaaagggctacatgtttctttttcatataagttgttcattgagttatgataggaatatattcataaataagcaaagaaaaatacctaattgtaattatcaaaggttcacttaaaaaattaactattaggtaaacttaagggggcagtgaaaaatctatttatgatttcgggagtaacctaaccatgaataatattagcataatgagaacatttactttttaaataaataactaaattttgtttacaatatgagtttttccagaatacaaggtttcaataatcacatgaggagtttaaagttttaaatatatactcagacattcattgtaacacagagtgtatgtaaaatcatttcccccactcactggagggagtatttattgcagactttttgttcagcaacatttagtgtttcagtgaaagttggacagttggggcttaaaacatttatttgtaaaatgagctatgttcaaatgtaaatatttgtaatttaatgtatttaccacattgactgtactaattatttagtagtcatactgtaatttttatgttaataataactggagttcaaagtctagctattggtataatcatctaatattatatatatctccagtgcccctgaattttatgtttgatgactatatatttgggcatatatcttgttggattagaataaataaaacactttatattttcatgaactcta

SEQ ID NO: 6021 - DNA, 1341 bp, Homo sapiens
ccaccgcggagccggggacagggggagcagggcagtgctctgctgggtgaggggcacccagctccagaggctaggtgggcgtcgctggtgggtggactcctgggcgctgcgcggagccgcgccggctgggttagcgcgggcggggcgcttagtcccacccccagaggaggcggaagaggagcccgagcctggccgcgggctgggccccgccgcagctccagctggccggcttggtcctgcggtcccttctctgggaggcccgaccccggccgcgcccagcccccaccatgccacccgcggggctccgccgggccgcgccgctcaccgcaatcgctctgttggtgctgggggctcccctggtgctggccggcgaggactgcctgtggtacctggaccggaatggctcctggcatccggggtttaactgcgagttcttcaccttctgctgcgggacctgctaccatcggtactgctgcagggacctgaccttgcttatcaccgagaggcagcagaagcactgcctggccttcagccccaagaccatagcaggcatcgcctcagctgtgatcctctttgttgctgtggttgccaccaccatctgctgcttcctctgttcctgttgctacctgtaccgccggcgccagcagctccagagcccatttgaaggccaggagattccaatgacaggcatcccagtgcagccagtatacccatacccccaggaccccaaagctggccctgcacccccacagcctggcttcatatacccacctagtggtcctgctccccaatatccactctacccagctgggcccccagtctacaaccctgcagctcctcctccctatatgccaccacagccctcttacccgggagcctgaggaaccagccatgtctctgctgccccttcagtgatgccaaccttgggagatgccctcatcctgtacctgcatctggtcctgggggtggcaggagtcctccagccaccaggccccagaccaagccaagccctgggccctactggggacagagccccagggaagtggaacaggagctgaactagaactatgaggggttggggggagggcttggaattatgggctatttttactgggggcaagggagggagatgacagcctgggtcacagtgcctgttttcaaatagtccctctgctcccaagatcccagccaggaaggctggggccctactgtttgtcccctctgggctggggtggggggagggaggaggttccgtcagcagctggcagtagccctcctctctggctgccccactggccacatctctggcctgctagattaaagctgtaaagacataactca

SEQ ID NO: 6022 - DNA, 1503 bp, Homo sapiens
atggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtga

SEQ ID NO: 6023 - DNA, 1759 bp, Homo sapiens
cgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaaggagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtga

SEQ ID NO: 6024 - DNA, 2391 bp, Homo sapiens
cgccgccactgccgcccgcgcctcgatggcgccatcgccccggagccgctgaccgctcagcgcctccagcccggcccgcgcggcgggtcctccgagcccggcccgccgggggagcggcctgccgcggaagcctccccgcgccctcccgcccggccccgccatggcgctgcggcgcctcctgctgctgctgctgctctcgctggagtccctggacctgctgcccagcgtccacggagcccgcggccgcgccgccaaccggaccctgagtgcaggcggcgctgccgtcgggggccggagggccgggggcgccctggcacggggcggccgcgagctgaacggcaccgcccgggcgcccggaatcccggaggcgggaagccggcgggggcagcccgcggcggctgtggcggcggcggccagcgcggccgtcacctacgagacgtgctggggctactacgacgtgagcggccagtacgacaaggagttcgagtgtaacaacagcgagagcggctacctgtactgctgcggtacctgctactaccgcttctgctgcaagaagcgccacgagaagctggaccagcgccagtgcaccaactaccagagcccggtgtgggtacagacgcccagcaccaaggtggtgtcgccggggcccgagaacaagtacgacccggagaaggacaagaccaacttcaccgtctacatcacctgcggggtgatcgccttcgtcatcgtggccggcgtcttcgccaaggtctcctacgacaaggcccaccgccctccacgggagatgaacatccacagggctctggctgacatcttaagacaacagggaccaatccccatagcacactgtgaaagagaaactatctcggctatcgatacctctcccaaagagaacacgccggtcagatcgtcctccaaaaaccactacactcctgtgcgtacggccaagcagactccagggcattatgggaaggatgcttaccgaagtggaggacctgatctccataacttcatctcatctggatttgtcacattaggaagaggacacaccaagggtgatcatcaatataaccatccgattttgagcagtgttacccagatcccgccacatgagaagccacggatgaacaacatcctgacatcagccaccgagccctatgacctctccttctcccgctcgttccagaacttggcccacctgcccccatcctacgagtctgcagtaaagaccaaccccagcaagtattcatctctgaagaggctaaccgacaaggaggctgacgagtattacatgagacggcggcacctgcccgacctggctgcccgcggcaccctccccctcaatgtcatccagatgtcccaacagaagccgttgccaagggaacgaccccgccggcccatccgggccatgtcccaggacagggtcctgtccccggatcggggcctgccagatgagttcagcatgccctacgaccgcatcctgtccgacgagcagctgctctccacggagcgcctgcactcccaggacccgctgctgtccccggagcggacggcctttcccgagcagtcgctgtccagggccatctcgcacacggacgtctttgtgtccacacccgtgctggaccgctaccgcatgagcaagatgcactctcatcccagtgcctccaataactcatacgccaccctgggccagagccagacggcagccaagcgtcatgcctttgcctcacgcagacacaacacggtggagcagctgcactacatcccgggccaccacacctgctacacagccagcaagaccgaagtgaccgtgtgaccggcggggcagggccggggctgctgggcgtggcagagcagagcgggggccgggaggggccaggagcagagcttctagccttgccactctcccttcccttgtcccctctgtaggaagtgggggtgggccacctttgcccaaaaagccatacccccggggacacagccccgatggcctggtccaatacacttagacccaggaccaagagcaatcgctcttgctcctccagaagaatcagtggggagtgaggagggggctaggccccattctcacccccgaccaccttcaccaactccctttccgtcccgcgcctccttctccccatccgggggactcagctgcaggttctgtcagcagagagacccttgcttgactgtggtctgaagctgcctgggtttgaaggggccagcgggtccaatcagtgggctgaccggataggctactcggtctcattcattcatctagaaccgcatcacagaaatctcctagtgcctaaaaactgcctgctcgctctctcagagccagggagctgctgtgtccataagcacaataatgattcttttcttgcctgctgg

SEQ ID NO: 6025 - DNA, 1840 bp, Homo sapiens
gccgcacccactcctgcccctgcctgcaccccacccacttcccggggacttccgagcccacgcccacatcctttacctccaaggggcaaggaagctgttgacttaagatcccatgtggagcagtcagatgctgctggagaactccccgcactgcaggctccagacacacgacctggcccctcccccgtggacgcctatactgctctgttctctaattccagggttcccaacctcggggttgtgccttgcaaatacctgggaaacttttctagctaatgcctaggcccctaccaacccagaaattcccatctaataatctagggtacagcctaggcattgaaacgttaagcctaagagaaatccggcgcacgcatccagtttccaccaccgaatttccagcttcttaaatctgcaggtccagaaaaagaagatgggagtgctgcccacgtcgcgcactggggctacggccggccccacccctggcgctgccgcggcagtcccgcccttggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccacagatgtaagaaa

SEQ ID NO: 6026 - DNA, 2399 bp, Homo sapiens
ggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccagacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacctatttggttgagttttggttttttctttttctttttttttccaaaaataaagacagcccatttttgtcatttccattaccacagatgtaagaaagtgataagccatggccatgagctgccctgagctttggtcgttggggaggtggctcaaatggagccagcggctgtggttgacctgccttggggagcagggctgaggggcgaagaggacatgtggatatccagccagaatgccctctctccagaggacacacagctctggatttctacccccttgctatcctctctggccattttgaacctgtaccacctaatgtagaaaaggcccgcctccagtgcccttctttccaaaacagctacacaaatgcttctgaatgccctggatacgcagaccgagtggcagtctggctaaaggcccatccagcactattgtgcccaagagccttaccgggcattccctgaagccccctcataggcagtgatcctagaccaaactcttaaatagaatcacttttgtttcctagaagagatcaaagagtggttgcttcttactttgaagatgaaattataccaagttaggttttttgctatctattgatccaaaaaatatattcgtgcaattaaagttaagtgttcaacttagtatttcaagttgggattcaggttgaggcattttcctgcagaatgggcaattttatgcatttatattcatcagtgctgccctcactttggatctattgtattcttacagtttaatcaactggcaaagtgctttcatgctttggagattaactataaaagcaagattaagaaaaatatgttaattaccatatccctggaactccttctcaggctggtgggggcagccttgcaagagaaacagcagcctttgtctcttccctcttgtggggagcaaggaggggatgagcggtaccttgggagacccggtaaaagtctaaagaattgagaatttgactatcttgggggtaaaatgctgtcataggggcagcagtctcagggggtgtaaactctggaatccactatggtttaccttgagtggcctgcacgaacatgacagccctgatctgtatttcctttccattcagaaaaccttaaaaaaaaaaaacttgttttatgataatattataacaatcataactaacatttactgtgcccggcagcaaattaagtatttgacaaacattatttcattaaacgagactgtcaatcattactcaaagaatgatgaaggtatttggtgtatgccaaagaataaaggcgttttatttcac

SEQ ID NO: 6027 - DNA, 1986 bp, Homo sapiens
agagtgcctggtgactcttacgctagcctcatttctcggcttcatcttgttagaacaaatttcctcgccctcttctcctaggccgcctgccagcgccgcacccactcctgcccctgcctgcaccccacccacttcccggggacttccgagcccacgcccacatcctttacctccaaggggcaaggaagctgttgacttaagatcccatgtggagcagtcagatgctgctggagaactccccgcactgcaggctccagacacacgacctggcccctcccccgtggacgcctatactgctctgttctctaattccagggttcccaacctcggggttgtgccttgcaaatacctgggaaacttttctagctaatgcctaggcccctaccaacccagaaattcccatctaataatctagggtacagcctaggcattgaaacgttaagcctaagagaaatccggcgcacgcatccagtttccaccaccgaatttccagcttcttaaatctgcaggtccagaaaaagaagatgggagtgctgcccacgtcgcgcactggggctacggccggccccacccctggcgctgccgcggcagtcccgcccttggacttgggcggcgcctggataaacacctgaacctgactgagctccgagccagggactcgggtgcctggggcagacgaggccggcttctccgcggacagctagggagagtgtcctgggtgtcagccagaacatgtctttcaacctgcaatcatcaaagaaactgttcattttcttaggaaaatcactgtttagtcttctggaggctatgatttttgccttactcccaaagccacggaagaacgttgctggtgaaatagtcctcatcacaggtgctggaagtggactcggaaggctcttagccttgcagtttgcccggctgggatctgttcttgttctctgggatatcaataaggaggggaatgaggaaacatgtaagatggctcgggaagctggagccacaagagtgcacgcctatacctgcgattgcagccaaaaggaaggagtgtatagagtagccgaccaggttaaaaaagaagtcggcgatgtttccatcctaatcaacaatgccggaatcgtaacaggcaaaaagttccttgactgtccagatgagcttatggaaaagtcatttgatgtgaatttcaaagcacatttatggacttataaagcctttctacctgctatgattgctaatgaccatggacatttggtttgcatttcaagttcagctggattaagtggagtaaatgggctggcagattactgtgcaagtaaatttgcagcctttgggtttgctgaatctgtatttgtagaaacatttgtccaaaaacaaaaggggatcaaaaccacgattgtgtgccccttttataaaaactggaatgtttgaaggttgtactacaggctgtccttctctgttgccaattctggaaccaaaatatgcagttgaaaaaatagtagaagctattctacaagaaaaaatgtacttgtatatgccaaagttgttatacttcatgatgtttcttaaaaggcttcatctggcacaggatgggtcagaatgcctgactgaggctatgtgggacagagcaaaggatcctggacaagcaattcgaaattcaggcttacgatcccactattcactaagtctgtgactctgagcgtgccctttattctccagctttttgcccctcaagacaggactgcttatagctgactatttgggcatccttcatgcaatggatggctttgttgaccaaaagaagaagctctaaagaccaactctatggctaaggtcatctgatacacagtgttacataatgcgtacttcaatgaagaaaagtatttttgtctgacagtggaatatatctggagaccacaagtaccactcctattctgttatctggactagaattttcaatcaatgtgtttgaaaataatgttgctatcacct

SEQ ID NO: 6028 - DNA, 2769 bp, Homo sapiens
aggtccgacggcttcggcgccccagctgtggtgatgggtagctaggaggcctgggcctctctgcctgctgtagccgtctgccgcgcccttgttcctgcagctgtccagttatcttttgactgccacatatggaccccaaaagatctcaaaaggaaagtgtcctcattacaggaggaagtggctattttggttttcgcctgggctgtgccctgaaccaaaatggagtccatgtgattctgtttgacatcagcagccctgctcaaaccattccagaaggaatcaagtttatacaaggagacatccgccacctgtctgacgtagagaaagccttccaggatgcagacgtcacttgtgtgttccatattgcctcttatggtatgtcagggcgggagcaactcaatcgaaacctgatcaaagaagtcaacgtcaggggcacagacaacatcctccaggtttgccaaaggagaagggtgcccaggttagtttacaccagcactttcaatgtcatctttggaggtcaagttatcagaaatggggatgaatctctgccctacctgcctcttcacctccaccctgatcactactctcggacaaagtcaattgcagagcagaaggtgctggaggcgaatgctacacccctggacagaggcgacggtgtcttaagaacctgcgctctgaggccagctggcatctatgggcctggagaacaaagacaccttcccaggatagtcagctacatcgagaagggtctgttcaagtttgtctacggggaccccaggagcctggttgagtttgtccacgtggataacttggtgcaggctcacattctggcctcagaagccctgagagctgacaagggccatattgcctctgggcagccctacttcatctcagatggcagacccgtgaacaactttgagttcttccggcctctggttgagggcctgggctacacattcccgtctacccgcctgccattgaccttggtctactgctttgcttttctaacagagatggttcacttcattttgggtcgactctacaacttccagcccttcctcactcgcactgaagtttacaaaactggtgtcacacattattttagcttagagaaagccaagaaagagctaggttataaggctcagccatttgacctccaggaagcagtggaatggtttaaagcccatggtcatggcagaagttctggaagtcgtgactcggagtgttttgtttgggatgggctattggtcttcctcctgattatagcagttctcatgtggctgccttcttctgtgattctgtcactgtgaaggaggggccagaaataaggtgatcacagttggctgagatggttctcaagaaacatgggttttaaaatgtgtacagtgatatctggtgccaaacattggctcttcaaattgctacttaagaataggttcttggattgaatctttatgtcttatttccttgcactaatccagatgggaatgaaaaagcagaagcagagattagtttgaaatttgatttgttatgtgcttctgttttaggtgggtacaatagaagtcagtttggagccatagaagtaggcttagttgagttggagatgcccatcttgaatttctgagagggcaagatatacttatttccattttatgcagtctgcatctacctaaaacctctgactgatgtgggaatggcgaaacactatcaggcttgaatgcgtgtgaaaaacaccaaattggcccagatccctaacagagcaatcctcgaggggatggtggctattgctggagaggcattagctattcacagggtacgttttaggtgttaacttttgccctttatgatatcagggcattatgcctatgtgaacacatggtaatgtttgatgtttaggcctttattctacctcataggattcttttgaggattaaattcaagcatacaaagcgctcctcaacacacatagccattctttttatcagaattgtcatggtacattccttatgagggctttcttcctcagtgttctctttagagggctattgctactggactttctgcaatgtctttgggtgtgccctcagagcctgcaacaagtgtatttggatatactctatttgtaaagtttaggcctctaagaaggccacaatgaagcaactaaaaatctgatgattaagggagtcaatcaagctgatgccatttttagtttaaaaatgaagcagagctctaaactcatagatgggttttcttactgggaagaagattggctctctgaagacagcttccaatgaggaatgtattgaacaatggcagcactgtctggccacccacaaactgttacagatgatccagttacactgttgcataggaacccaagtggaaagaagacagagtccatgtctgtccatggctccagctacagaaaggatagtatgggaacattacaagggggatacattactgtggaaagttctgctagagttagtcttgagagtatctgtaaaatacaaatagatgagcaatccctgtggaatgctgcctggatattttcagaaaagctctgaacttgatgtcataataccaacaccgtgaatatcgtgtgtggccttaaccaaggaacagaagccctttagaacttagcttcctcacttgggagctgggactgactgcatttgccctttgtataaacccacccaccccatagggttcactgggagcataaagcaagatgtggtgaaagtacttctaatataaattgcaacatca

SEQ ID NO: 6029 - DNA, 1864 bp, Homo sapiens
acttccggttaagaatgcaacactcaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggt

SEQ ID NO: 6030 - DNA, 1957 bp, Homo sapiens
ggacgactggggtgaggcgggcagctaatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggt

SEQ ID NO: 6031 - DNA, 1999 bp, Homo sapiens
aacactcaggtgagaacttctcaggtggaaagcaggaagagggtggctagtgcaaggatcagatagcacctgcttggaagttcactgattaatgatttaacaagggcggtcacatgggacaactgctgcttttctctgccctcatttttcttactaacaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 6032 - DNA, 1964 bp, Homo sapiens
atttaaaattatagagcttttcatcactacggagatgctcttgcctatgataggaacgatggctacatctgaagctgagcaaatttatcttttctcttcgtctgcatcagggtgacctctggaaggtctgaaaattgaacaagatggacgggtccaggaaagaggaggaggaagacagcacattcaccaacatttctcttgcagatgacatagaccattcctcaagaattttgtatccaaggcccaaaagtttgttacccaagatgatgaatgctgacatggatgcagttgatgctgaaaatcaagtggaactggaggaaaaaacaagacttattaatcaagtgttggaactccaacacacacttgaagatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctatttcagaggttg

SEQ ID NO: 6033 - DNA, 1838 bp, Homo sapiens
aatgcgcaggcgtgtattctcgagtcaggattggcgggcgagcggctgggacgggatgggattcttctcacggcgcacgttctgtgggcggagtgggcggagctgccggggtcagttggtccaagtgtcccggcctgaggtgtcggccggatccctccttctcccggcgcctcaagcggaagaccattcctcaagaattttgtatccaaggcccaaaagtttgttacccaagatgatgaatgctgacatggatgatctctctgcaagagtagatgcagttaaggaagaaaatctgaagctaaaatcagaaaaccaagttcttggacaatatatagaaaatctcatgtcagcttctagtgtttttcaaacaactgacacaaaaagcaaaagaaagtaagggattgacacccttctgttttatggaattgctgctgatcattttttctttaaaacttggatagattccaaaagttacagtacctttgtggcttcattgaatatttatgaagataatgtcagatgtagacaaaaataacacaataacaggagacttccataagtttgtgtattatgttagtctatgaaaacgtgcaaatgtattgtagagactttatgattagaattgcatatatttatgaaacttaaagatgaatgttttattgaatttgtaggtttagcactgtcttttattataggattagtaagatatacaagaaaataaccaccgtgttgtgaaaaagtgaccaaaatcatgtactaaatgcacagctttatgtaccctgtccaccatcttgtgcctcttctccatttgcctcttccttcctatttcccttccgctaaggaaaaaaattggtgtcacatttgtaaaagtaattttaatagttaatcatctctgagagtaacctgtattttaattgttgaaacttaaccaaaataagatactgtctcagctagggcttgtcatttgtgtatttagtgttaagataggaatgctagtgtctctttaattaattggaaatagatggaggctaaaaatgaaggtttttctttgaaactgaattaacttgggaatatttgttgttaaaaacttctttttgcccaaaataactcattttgtattatctgaaaatatataatttctggtcatgtgtatgttaaaatagaaaattttgaggaaaaatggaaatagggtggaaaagtactcggtaaacagtagtaaccaaatattttcactccagatttgtgttttctctggcacagagtagatcttttgggaaatatatatgaaagtggattaagtttgactacccttatgttagccacatctggatgagaacagttacaaagagtttggtctctaagttgatttgtacccagtgggtcaacttctgcaaaattccgtaatggtgtattagtattagaatagtgaataaaatgggaaagttatacatgtatacttattatcttgctcagtattttatctcacttgttctagaattttctgtaaaccctgctactgggtttgaagagttttagtcatcctttaacaatttttaaaaatttagcttctagattccatttggtaaggaaatcaatattggaagtattgctaaaatcttataatatgaaaagagatccactaatgtagcttaaggttattagatttgggcttttaatcatggaataatcttatgtattggtgtaagagttgatgaatgactttagctgtgtgaatatataatagtcaaactgcaaacattttgcatcccttttgtgacctaatttacagacatttaaattgtgttgcagttctgctttgccgtttaataaaaagctat

SEQ ID NO: 6034 - DNA, 2018 bp, Homo sapiens
agccggacctgggactgggctggggccctggcggatggagacatgctgcccctgctgctgctgcccctgctgtggggggggtccctgcaggagaagccagtgtacgagctgcaagtgcagaagtcggtgacggtgcaggagggcctgtgcgtccttgtgccctgctccttctcttacccctggagatcctggtattcctctcccccactctacgtctactggttccgggacggggagatcccatactacgctgaggttgtggccacaaacaacccagacagaagagtgaagccagagacccagggccgattccgcctccttggggatgtccagaagaagaactgctccctgagcatcggagatgccagaatggaggacacgggaagctatttcttccgcgtggagagaggaagggatgtaaaatatagctaccaacagaataagctgaacttggaggtgacagccctgatagagaaacccgacatccactttctggagcctctggagtccggccgccccacaaggctgagctgcagccttccaggatcctgtgaagcgggaccacctctcacattctcctggacggggaatgccctcagccccctggaccccgagaccacccgctcctcggagctcaccctcacccccaggcccgaggaccatggcaccaacctcacctgtcaggtgaaacgccaaggagctcaggtgaccacggagagaactgtccagctcaatgtctcctatgctccacagaacctcgccatcagcatcttcttcagaaatggcacaggcacagccctgcggatcctgagcaatggcatgtcggtgcccatccaggagggccagtccctgttcctcgcctgcacagttgacagcaacccccctgcctcactgagctggttccgggagggaaaagccctcaatccttcccagacctcaatgtctgggaccctggagctgcctaacataggagctagagagggaggggaattcacctgccgggttcagcatccgctgggctcccagcacctgtccttcatcctttctgtgcagagaagctcctcttcctgcatatgtgtaactgagaaacagcagggctcctggcccctcgtcctcaccctgatcaggggggctctcatgggggctggcttcctcctcacctatggcctcacctggatctactataccaggtgtggaggcccccagcagagcagggctgagaggcctggctgagcccctcccgctcaagacagaactgaggtgtggacacttagccctgtgggacacatgcaggacatcactgtcagcttctttctggaagctcacatcccactgactacccctcttttccttcctgccccataccccttctacttattcccctctgcttgtgagtcttgccccaccacacctgcatccccatctgcaccccatcccctctccacctgcccttctcttccctctccatccaccatctccagccctgtgaagggaatgtactttcggtcttatacccccattacccattacccaaaagttaccttttttttttttttttttttttgagacagagtctcactctgttgcacaggctggagttcagtggcacaatctccgttcactgcaacctccacctctggggttcaagcaattctcctgcctcagcctccctagtagctgggattacaggtgcctgccaccacatccagttaattttttttttttgtatgttagtagagatggggttttaccatgttggccaggtctcgaactcctgacctcaagcaatccactgcattggcctcccaaagtgctggcattacaggtatgagccaccgtgcctggctgccaaaagttaccttcttaacacttgaatttctggtctcctcagcttccctatccatataggcacagagaggcagcatttgttttccagttaaaactctacctcattgtgattattatccaatacaattgttacaaaataagtaaaacttttatgaaacaatacaacataa

SEQ ID NO: 6035 - DNA, 1505 bp, Homo sapiens
tccggctcccgcagagcccacagggacctgcagatctgagtgccctgcccacccccgcccgccttccttcccccaccacgcctgggagggccctcactggggaggtggccgagagcgggtctggcctggggtgttcagatgctcacagcatggaaaagtccatctggctgctggcctgcttggcgtgggttctcccgacaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctgcacgtgacagccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtgaggagtccctcagccaccaacatccatttcagcactgtaaagaacaaaggccagtgcgaggcttggctggcacagccagtcctggttctcgggcaccttggcagcccccagctgggtggctcctcccctgctcaaggtcaagaccctgctcaaggaggctcatctggcctcctatgtggacaaccatttcggagctccctgatatttttgccagcatttcgtaaatgtgcatacgtctgtgtgtgtgtgtgtgtgtgagagagagagagagagagtacacgcattagcttgagcgtgaaacttccagaaatgttcccttgccctttcttacctagaacacctgctatagtaaagcagacaggaaactgtt

SEQ ID NO: 6036 - DNA, 1054 bp, Homo sapiens
aggctacatcgggactctgaagagcagcactctggggtgggcacaggccccacagcagggtcagcctgtggccctgcctctccatcagctcaggctcatttgtgagaactaaaatagatactacggagaacttgctcaacacagaggtgcacagctcgccagcgcagcgctggtccatgcaggtgccacccgaggtgagcgcggaggcaggcgacgcggcagtgctgccctgcaccttcacgcacccgcaccgccactacgacgggccgctgacggccatctggcgcgcgggcgagccctatgcgggcccgcaggtgttccgctgcgctgcggcgcggggcagcgagctctgccagacggcgctgagcctgcacggccgcttccggctgctgggcaacccgcgccgcaacgacctctcgctgcgcgtcgagcgcctcgccctggctgacgaccgccgctacttctgccgcgtcgagttcgccggcgacgtccatgaccgctacgagagccgccacggcgtccggctccgcgccgcggatcgtcaacatctcggtgctgcccagtccggctcacgccttccgcgcgctctgcactgccgaaggggagccgccgcccgccctcgcctggtccggcccggccctgggcaacagcttggcagccgtgcggagcccgcgtgagggtcacggccacctagtgaccgccgaactgcccgcactgacccatgacggccgctacacgtgtacggccgccaacagcctgggccgctccgaggccagcgtctacctgttccgcttccatggcgccagcggggcctcgacggtcgccctcctgctcggcgctctcggcttcaaggcgctgctgctgctcggggtcctggccgcccgcgctgcccgccgccgcccagagcatctggacaccccggacaccccaccacggtcccaggcccaggagtccaattatgaaaatttgagccagatgaacccccggagcccaccagccaccatgtgctcaccgtgaggagtccctcagccaccaacatccatttcagcactgt

SEQ ID NO: 6037 - DNA, 2288 bp, Homo sapiens
gaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggg

SEQ ID NO: 6038 - DNA, 2526 bp, Homo sapiens
gcgatggggtgctggcctgccaggagcacagatacagagctagagcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgccccgcatccaggtgccccgtgtgcccggcctgggcggctggccgtggatctgaccgctcctgcatggtggaggaccagcgttcccactgtctgcagctgtgccacctccctgtgccgggctgtgcgtgctcacgctcggctccgtctgcctttgtgcgatcagactgagagaccccccagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtg

SEQ ID NO: 6039 - DNA, 2352 bp, Homo sapiens
attgcgatggggtgctggcctgccaggagcacagatacagagctagagcccagcgaggcctgtgctgcgaggggctgtgctgtgccaggggaggccccgcacccgggaagcccagaggagagtgtgcactcacggagccctcctggcagggccgcgtctctggagcagcagacccgtgtccctctgggaggtcaactgcggcctcacagctgggcctgtcccagcacagcccttgttggagggcgcacccccgtgtcctcagcaccccagtgttgagtgcattgacctgcagaggggagcctgtgctggtcccgggcgtctgtgtggctcctgggtgcccatctgcacccctggccctgctctgggcttcagtggagccgtgccaccgtgggagtgtccagggtcctgacgtagccctgagacgtggccagctccctggcctgctgcccgcacagtgggcccttgtctctgctctgggtcaggcgaggcagccacccatgatgagctctgcagccttcccaaggtggctgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcgg

SEQ ID NO: 6040 - DNA, 1907 bp, Homo sapiens
agcttcacagtcaccgaagaaatgaagttacaggaggggcacaccgtccttttgtctctgcctttgaggttggcgggaactgaaactgcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttg

SEQ ID NO: 6041 - DNA, 2273 bp, Homo sapiens
gttgtcgcggaggcctgcgtgagtgaggcctggcgtgccctggaaacattcccctgagttgaagaaagactcacagttttcagcatccagttaccctctgagcatcaggcagaacccgccggccccaaaaccaggcccccttggcacatgtgggcccgagtgagtccagcatgaggaggtgccgcttctgagcagagctcaggttgtctctgggaggaggagcgagcgttgggtgcggtggccgctgcgttggcagccctgtccctgagcggaacgcaggtcgtctctgggaggaggagcgagggttggactcagtggccgctgcggtggcagccctgtccccaggcgtggactctgccctcagcttcacagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgcagggccaggcgcgggaccgcaggtagcccagggtgttgtgggtggcagcacttgtttactggctgctttctggctcgaaataaaggaatcgtgcttgtgtcggg

SEQ ID NO: 6042 - DNA, 845 bp, Homo sapiens
tctctgctctgggtcaggcgaggcagccacccatgatgagctctgcagccttcccaagcagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcc

SEQ ID NO: 6043 - DNA, 753 bp, Homo sapiens
cttttgtctctgcctttgaggttggcgggaactgaaactgattgaaaacagtgggcttgaaaagcctggagcagagggagtgaggcctgctccccaccccagctctgcgggcacaccctggccagacagccctgctccagacctggcctgtgtctcagggtggcccaggaggggactttgcaagagcatgggggtccctcgtaccccttcacggacagtgctcttcgagcgggagaggacgggcctgacctaccgcgtgccctcgctgctccccgtgccccccgggcccaccctgctggcctttgtggagcagcggctcagccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaa

SEQ ID NO: 6044 - DNA, 1762 bp, Homo sapiens
acagtcaccgaagaaatgaagttacaggaggggcacaccgtccttttgtctctgcctttgaggttggcgggaactgaaactgagcatgggggtccctcgtaccccttcacggacagtgctcttcgagcgggagaggacgggcctgacctaccgcgtgccctcgctgctccccgtgccccccctgacgactcccacgcccaccgcctggtgctgaggaggggcacgctggccgggggctccgtgcggtggggtgccctgcacgtgctggggacagcagccctggcggagcaccggtccatgaacccctgccctgtgcacgatgctggcacgggcaccgtcttcctcttcttcatcgcggtgctgggccacacgcctgaggccgtgcagatcgccacgggaaggaacgccgcgcgcctctgctgtgtggccagccgtgacgccggcctctcgtggggcagcgcccgggacctcaccgaggaggccatcggtggtgccgtgcaggactgggccacattcgctgtgggtcccggccacggcgtgcagctgccctcaggccgcctgctggtacccgcctacacctaccgcgtggaccgccgagagtgttttggcaagatctgccggaccagccctcactccttcgccttctacagcgatgaccacggccgcacctggcgctgtggaggcctcgtgcccaacctgcgctcaggcgagtgccagctggcggcggtggacggtgggcaggccggcagcttcctctactgcaatgcccggagcccactgggcagccgtgtgcaggcgctcagcactgacgagggcacctccttcctgcccgcagagcgcgtggcttccctgcccgagactgcctggggctgccagggcagcatcgtgggcttcccagcccccgcccccaacaggccacgggatgacagttggtcagtgggccccgggagtcccctccagcctccactcctcggtcctggagtccacgaacccccagaggaggctgctgtagacccccgtggaggccaggtgcctggtgggcccttcagccgtctgcagcctcggggggatggccccaggcagcctggccccaggcctggggtcagtggggatgtggggtcctggaccctggcactccccatgccctttgctgccccgccccagagccccacgtggctgctgtactcccacccagtggggcgcagggctcggctacacatgggtatccgcctgagccagtccccgctggacccgcgcagctggacagagccctgggtgatctacgagggccccagcggctactccgacctggcgtccatcgggccggctcctgaggggggcctggtttttgcctgcctgtacgagagcggggccaggacctcctatgatgagatttccttttgtacattctccctgcgtgaggtcctggagaacgtgcccgccagccccaagccgcccaaccttggggacaagcctcgggggtgctgctggccctcctgacaggccttctggccgtgcccatgccccttgggtgcctggggcagaggggtggaatacgttggggtgccccacgatagctgtggggggggctcttagtgcaagatcctgtggattagaaacaagttgctcctcagagctctcaagcagggactgctctttaggaaggggagcagcggctgggagtgagcagggcagggtgggggcagggtgggggcacgaagtgggccctgggtgacccccacagctcccttccgaggctgca

SEQ ID NO: 6045 - DNA, 5080 bp, Homo sapiens
acatatttacatacatacacatatggtgagggagagaacgtgatgacgtgagactctccatggagagtaggaggtaataaagaaataaaacaggtgtctgaggagaggttctattagagaggggagaatagagagtaattatcgttcagacaggcaagagttctctgcaggtagcagcctgggaaagcgaactcgcgcaccctcttgggggacgggctcttttgctttctatttcttctcctgcagccagggtgcacacgtatttgaaacagaccgaatttcctcctcgatgtggcgtcaggttgacttttcgagactagcgggtatttctttttaatgactccaatgcctttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaacactttgggaggctgaggcaggaggatcacttgagcccaggagattgacgccgcagtgaactatgattgtgcccctgcactccagcctggatgacagagtgagaccccatctcttaaaaaataaaaaaaaataaaaatttgaacctgtttcacta

SEQ ID NO: 6046 - DNA, 5016 bp, Homo sapiens
aataaagaaataaaacaggtgtctgaggagaggttctattagagaggggagaatagagagtaattatcgttcagacaggcaagagttctctgcaggtagcagcctgggaaagcgaactcgcgcaccctcttgggggacgggctcttttgctttctatttcttctcctgcagccagggtgcacacgtatttgaaacagaccgaatttcctcctcgatgtggcgtcaggttgacttttcgagactagcgggtatttctttttaatgactccaatgcctttttattattgctgttattgaggttgagggagaagagatcggtctaaattctggctgggtaagtggggggattctcggcgatgagaaacgggggacttagaagccggaggaaaatcagcagccccacatctccacttctccagtccgccctactctccacccgtgacctccagtggagaccccaggcggcagcatcagtatttgatcggcccttcgtcagcacgctgccagccctggccggctgggttcgccaggcatcacccgctcggctctgaagcggacgcctggccctgcaccgggctttggaaggaccctctctgcgctcgccccctccccagggtggctccgctttcgagcccgggcgcggtgcccaccatgcgcggctgcctgcggctcgcgctgctctgcgcgctgccctggctcctgctggcggcgtcgcccgggcacccggcgaaatcccccaggcagcccccggcaccgcgccgcgaccccttcgacgctgccaggggcgccgatttcgatcatgtctacagcggggtggtgaacctcagcaccgagaacatctactctttcaactacaccagccagcccgaccaggtgacagccgtgagggtgtatgtgaacagttcctctgagaatctcaactacccggtccttgttgtggttcgccagcagaaagaggtgctgtcctggcaggttcctctgctcttccaaggactataccagaggagctacaactatcaagaagtgagccgcaccttatgtccctcagaagcaaccaatgagacgggacccttgcagcaactgatatttgtagatgtcgcatccatggcacccctgggtgctcagtacaaactgctagttaccaagctgaagcacttccagctccggacaaatgttgcctttcactttactgccagcccctctcaacctcagtattttctatacaagtttcccaaagacgtggactcagttatcattaaagtggtgtctgaaatggcttatccatgttctgttgtctcagtccagaatatcatgtgcccggtgtatgatctcgaccacaatgtggaatttaatggtgtctatcagtccatgaccaagaaagctgccatcacgctacagaagaaggattttccaggcgagcagttcttcgtggtatttgtgataaagcctgaagattatgcctgtggaggatctttcttcatccaggaaaaggaaaaccagacctggaatctacagcgaaaaaagaaccttgaagtgaccattgtcccttccattaaagaatctgtttatgtgaaatccagtcttttcagtgtcttcatcttcctgtccttctacttgggatgccttcttgttgggtttgttcattatctgaggtttcagagaaaatccattgatggaagctttgggtccaatgatggctctggaaatatggtggcatctcatcccattgctgccagcacacccgaagggagcaattatgggacaatagatgagtcaagctccagtcctggaaggcagatgtcctcctccgatggtgggccaccgggccagtcagacacagacagctccgtggaggagagcgacttcgacaccatgccagacattgagagtgataaaaacatcatccggaccaagatgttcctttacctgtcagatttgtccaggaaggaccggagaattgtcagcaaaaaatataaaatttatttttggaacatcatcaccattgctgtgttttacgcgctgcccgtgatccagctggtcattacctatcagacagtggtaaatgtcactggcaaccaggacatctgttactacaacttcctctgtgctcaccccttgggcgtcctgagtgccttcaacaacattctcagcaatctgggccacgtgcttctgggcttcctcttcctgctgatagtcttgcgccgcgacatcctccatcggagagccctggaagccaaggacatctttgctgtggagtacgggattcccaaacactttggtctcttctacgctatgggcattgcattgatgatggaaggggtgctcagtgcttgctaccatgtctgccctaattattccaacttccaattcgacacctccttcatgtacatgatcgctggcctgtgcatgctgaagctctatcagacccgccacccagacatcaatgccagcgcctactctgcctatgcctcctttgctgtggtcatcatggtcaccgtccttggagtggtgtttggaaaaaatgacgtatggttctgggtcatcttctctgcaatccacgttctggcctcgctagccctcagcacccagatatattatatgggtcgtttcaagatagctattacccctacagatttgggaattttccggcgggctgccatggtgttctacacagactgtatccagcagtgtagccgacctctatatatggatagaatggtgttgctggttgtggggaatctggttaactggtccttcgccctctttggattgatataccgccccagggactttgcttcctacatgctgggcatcttcatctgtaaccttttgctgtacctggccttttacatcatcatgaagctccgcagctctgaaaaggtcctcccagtcccgctcttctgcatcgtggccaccgctgtgatgtgggctgccgccctatattttttcttccagaatctcagcagctgggagggaactccggccgaatcccgggagaagaaccgcgagtgcattctgctggatttcttcgatgaccatgacatctggcacttcctctctgctactgctctgtttttctcattcttggttttgttaactttggatgatgaccttgatgtggttcggagagaccagatccctgtcttctgaacctccaacattaagagaggggagggagcgatcaatcttggtgctgtttcacaaaaattacagtgaccacagcaaagtaaccactgccagatgctccactcaccctctgtagagccaactctgcattcacacaggaaggagaggggctgcgggagatttaaacctgcaagaaaggaggcagaaggggagccatgttttgaggacagacgcaaacctgaggagctgagaaacacttgctccttccatctgcagctttgggagtgcaacagggataggcactgcatccaagtcaactcaccatcttggggtccctcccaccctcacggagacttgccagcaatggcagaatgctgctgcacacttccctccagttgtcaccctgcccagaaaggccagcagcttggacttcctgcccagaaactgtgttggcccccttcacacctctgcaacacctgctgctccagcaagaggatgtgattctttagaatatggcggggaggtgaccccaggccctgccctactgggatagatgttttaatggcaccagctagtcacctcccagaagaaactctgtatatttcccccaggtttctgatgccatcagaagggctcaggagtggggtttgtcacacattcctcttaacaagtaactgtcactgggaccgagtcctgggtgcttacatattccttcgtgtcttcatctcactgacctgtgtggacctcatcactctgactctgccttcttggaaaggccctgtcactccacagatgtctggccagcttcaaggcagaaggaaaaacaggaaaagctcttttaacagcagcaggaacaagagaaatgactaaccatactaaaagactggtaacagcagcagcagccagacaggcctcaccttaaggacttgggctgccagagcaaattcagcagagcttatttggcctcccattcacacagctcagttctgtgcccacatcacctttggggaagaaatcagcattctaatcagggacactacttcaggagtcctccacagcgagtccgtcatctgtcactttatgtagatcagggttctagacttcttccctgaggttctcagaagcagctctcaggatgaacgtattgtcctcttcccctcttcttgcaaagtgcacagctaatctaatgttgtctctcggttgcacctgacattctctccccagtaaggtgttggcaagctcagcatctgggttccactctcacactgtctggcagctctgtgtctgagaagttctacattgaccaggcccccttgttgcctggagtatgacgtaatcagaaaatagacgtataaatgtgcacatgcgtatgtatttgcttgtgaaattaaagtcacctcttgcctctgctttcctgatcattcgttagagaaatggatcaggcatttttttaaattattattctttctctaaactatttgcattgtgttcaaaaacccattttagaagtttgaacagcaagcttttcctgattttaaaaacacaaagttgctttcaatgaaatattttgtgatttttttaaagtccccaaatgtgtacttagccttctgttattccttattctttaagcagtgttggcttccattgaccatatgaaggccaccaattaaatggttgtgttaatccaacatgtaaaaaactttttggcagggcacagtggctcacgcctgtaatcccaacactttgggaggctgaggcaggaggatcacttgagcccaggagattgacgccgcagtgaactatgattgtgcccctgcactccagcctggatgacagagtgagaccccatctcttaaaaaataaaaaaaaataaaaatttgaacctgtttc

SEQ ID NO: 6047 - DNA, 3135 bp, Homo sapiens
gccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccaggggcacgaccagttcaagcggcgcctcccctctggccagatgcggcagctgtgcattgccatgggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtaagcgggcctcccggccgagccgggtgggtacgtgaaggtagcagctgcctccttctctgtggctgatctggcgtccacaccccaggtgttgctgacactggatgacgacctggatactaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactcagt

SEQ ID NO: 6048 - DNA, 4406 bp, Homo sapiens
ctcacttttcagtgttcgtgcgtcgggacggcgcgtccgcccgcccttaaagggcccgcacctcggaaaactcgcagcccagcacggcgtcgggtagctaccacctatcacgcccctcactctgcgactcgccttcctccgcggccagcccccgccgccggctcttcctccctcccctttcccggcgtctccaggctcccggcaaccagccgccctccttctcacggccctggcccggggctccagggtctcaggtcgtactcagcccctcgcgagctgggaccccttcccgtagccagcatcccctccctccccgccccctcccggccgccccctcccctgcggggaccctgggagcctcttcggggctcttgggaggggacatttcctaatctcaggccggggttaaagttctggtcctggtgagatgctggaagctgcggccgcagccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcggtcaccctcgagtcctggctgattcttttcctggcagttccccttatgagggttacaactatggctcctttgagaatgtttctggatctaccgatggtctggttgacagcgctggcactggggacctctcttacggttaccagggccgctcctttgaacctgtaggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatgtgtttttctcccaaacttgtttttatagctctgcttgaagggctgggagatgaggtgggtctggatcttttctcagagcgtctccatgctatggttgcatttccgttttctatgaatgaatttgcattcaataaacaaccagactca

SEQ ID NO: 6049 - DNA, 1860 bp, Homo sapiens
ccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatg

SEQ ID NO: 6050 - DNA, 3789 bp, Homo sapiens
ccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaaaaagtggaacgaaccctgtgtcagccccccaccaagaatgagtcggagattcagttcttctacgtggatgtgtccaccctgtcaccagtcaacaccacataccagctccgggtcagccgcatggacgattttgtgctcaggactggggagcagttcagcttcaataccacagcagcacagccccagtacttcaagtatgagttccctgaaggcgtggactcggtaattgtcaaggtgacctccaacaaggccttcccctgctcagtcatctccattcaggatgtgctgtgtcctgtctatgacctggacaacaacgtagccttcatcggcatgtaccagacgatgaccaagaaggcggccatcaccgtacagcgcaaagacttccccagcaacagcttttatgtggtggtggtggtgaagaccgaagaccaagcctgcgggggctccctgcctttctaccccttcgcagaagatgaaccggtcgatcaagggcaccgccagaaaaccctgtcagtgctggtgtctcaagcagtcacgtctgaggcatacgtcagtgggatgctcttttgcctgggtatatttctctccttttacctgctgaccgtcctcctggcctgctgggagaactggaggcagaagaagaagaccctgctggtggccattgaccgagcctgcccagaaagcgcttctctccttggtcaccctcgagtcctggctgattcttttcctggcagttccccttatgagggttacaactatggctcctttgagaatgtttctggatctaccgatggtctggttgacagcgctggcactggggacctctcttacggttaccagggtactcggccccgagtggactccatgagctctgtggaggaggatgactacgacacattgaccgacatcgattccgacaagaatgtcattcgcaccaagcaatacctctatgtggctgacctggcacggaaggacaagcgtgttctgcggaaaaagtaccagatctacttctggaacattgccaccattgctgtcttctatgcccttcctgtggtgcagctggtgatcacctaccagacggtggtgaatgtcacagggaatcaggacatctgctactacaacttcctctgcgcccacccactgggcaatctcagcgccttcaacaacatcctcagcaacctggggtacatcctgctggggctgcttttcctgctcatcatcctgcaacgggagatcaaccacaaccgggccctgctgcgcaatgacctctgtgccctggaatgtgggatccccaaacactttgggcttttctacgccatgggcacagccctgatgatggaggggctgctcagtgcttgctatcatgtgtgccccaactataccaatttccagtttgacacatcgttcatgtacatgatcgccggactctgcatgctgaagctctaccagaagcggcacccggacatcaacgccagcgcctacagtgcctacgcctgcctggccattgtcatcttcttctctgtgctgggcgtggtctttggcaaagggaacacggcgttctggatcgtcttctccatcattcacatcatcgccaccctgctcctcagcacgcagctctattacatgggccggtggaaactggactcggggatcttccgccgcatcctccacgtgctctacacagactgcatccggcagtgcagcgggccgctctacgtggaccgcatggtgctgctggtcatgggcaacgtcatcaactggtcgctggctgcctatgggcttatcatgcgccccaatgatttcgcttcctacttgttggccattggcatctgcaacctgctcctttacttcgccttctacatcatcatgaagctccggagtggggagaggatcaagctcatccccctgctctgcatcgtttgcacctccgtggtctggggcttcgcgctcttcttcttcttccagggactcagcacctggcagaaaacccctgcagagtcgagggagcacaaccgggactgcatcctcctcgacttctttgacgaccacgacatctggcacttcctctcctccatcgccatgttcgggtccttcctggtgttgctgacactggatgacgacctggatactgtgcagcgggacaagatctatgtcttctagcaggagctgggcccttcgcttcacctcaaggggccctgagctcctttgtgtcatagaccggtcactctgtcgtgctgtggggatgagtcccagcaccgctgcccagcactggatggcagcaggacagccaggtctagcttaggcttggcctgggacagccatggggtggcatggaaccttgcagctgccctctgccgaggagcaggcctgctcccctggaacccccagatgttggccaaattgctgctttcttctcagtgttggggccttccatgggcccctgtcctttggctctccatttgtccctttgcaagaggaaggatggaagggacaccctccccatttcatgccttgcattttgcccgtcctcctccccacaatgccccagcctgggacctaaggcctctttttcctcccatactcccactccagggcctagtctggggcctgaatctctgtcctgtatcagggccccagttctctttgggctgtccctggctgccatcactgcccattccagtcagccaggatggatgggggtatgagattttgggggttggccagctggtgccagacttttggtgctaaggcctgcaaggggcctggggcagtgcgtattctcttccctctgacctgtgctcagggctggctctttagcaatgcgctcagcccaatttgagaaccgccttctgattcaagaggctgaattcagaggtcacctcttcatcccatcagctcccagactgatgccagcaccaggactggagggagaagcgcctcaccccttcccttccttctttccaggcccttagtcttgccaaaccccagctggtggcctttcagtgccattgacactgcccaagaatgtccaggggcaaaggagggatgatacagagttcagcccgttctgcctccacagctgtgggcaccccagtgcctaccttagaaaggggcttcaggaagggatgtgctgtttccctctacgtgcccagtcctagcctcgctctaggacccagggctggcttctaagtttccgtccagtcttcaggcaagttctgtgttagtcatgcacacacatacctatgaaaccttggagtttacaaagaattgccccagctctgggcaccctggccaccctggtccttggatccccttcgtcccacctggtccaccccagatgctgaggatgggggagctcaggcggggcctctgctttggggatgggaatg

SEQ ID NO: 6051 - DNA, 569 bp, Homo sapiens
agtgttcgtgcgtcgggacggcgcgtccgcccgcccttaaagggcccgcacctcggaaaactcgcagcccagcacggcgtcgggtagctaccacctatcacgcccctcactctgcgactcgccttcctccgcggccagcccccgccgccggctcttcctccctcccctttcccggcgtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctacca

SEQ ID NO: 6052 - DNA, 540 bp, Homo sapiens
acttttcagtgttcgtgcgtcgggacggcgcgtccgcccgcccttaaagggcccgcacctcggaaaactcgcagcccagcacggcgtcggttctggtcctggtgagatgctggaagctgcggccgcagccgcaacccgtcccggaggtgtcctgtctcctgtcgccgccgccgccgccaccaccgctgccactgccgccctgccggggccatgttcgctctgggcttgcccttcttggtgctcttggtggcctcggtcgagagccatctgggggttctggggcccaagaacgtctcgcagaaagacgccgagtttgagcgcacctacgtggacgaggtcaacagcgagctggtcaacatctacaccttcaaccatactgtgacccgcaacaggacagagggcgtgcgtgtgtctgtgaacgtcctgaacaagcagaagggggcgccgttgctgtttgtggtccgccagaaggaggctgtggtgtccttccaggtgcccctaatcctgcgagggatgtttcagcgcaagtacctctaccaa

SEQ ID NO: 6053 - DNA, 10397 bp, Homo sapiens
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 6054 - DNA, 6997 bp, Homo sapiens
cctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaaggtaggtgccccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttc

SEQ ID NO: 6055 - DNA, 6651 bp, Homo sapiens
atgtgggggcttttgatctggacactgctagctctgcatcagatccgcgcggccagagcccaagatgatgtgtccccgtatttcaagacagagcctgtgcggacacaggtgcacttggaaggaaaccgcctggtgcttacatgcatggccgagggcagctggccactggagttcaagtggctccacaacaacagggagctgaccaagttctccctggaatacagatacatgatcaccagcctggaccgcacccacgctggcttttaccgttgcatcgtgcggaaccgaatgggggccctgctgcagcggcaaaccgaggtccaggtggcctacatggggagctttgaggaaggtgagaagcaccagagcgtctcccacggagaagcagctgtcatccgtgccccgcgcatcgccagcttcccccagccacaggtgacctggttccgggacggccgcaagatcccgcccagcagccgcatagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaa

SEQ ID NO: 6056 - DNA, 10664 bp, Homo sapiens
atgtgggggcttttgatctggacactgctagctctgcatcagatccgcgcggccagagcccaagatgatgtgtccccgtatttcaagacagagcctgtgcggacacaggtgcacttggaaggaaaccgcctggtgcttacatgcatggccgagggcagctggccactggagttcaagtggctccacaacaacagggagctgaccaagttctccctggaatacagatacatgatcaccagcctggaccgcacccacgctggcttttaccgttgcatcgtgcggaaccgaatgggggccctgctgcagcggcaaaccgaggtccaggtggcctacatggggagctttgaggaaggtgagaagcaccagagcgtctcccacggagaagcagctgtcatccgtgccccgcgcatcgccagcttcccccagccacaggtgacctggttccgggacggccgcaagatcccgcccagcagccgcatagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcactgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacatacacatacacaatctgctccaaggagtgttctgcaaaaagccacatccagtggccaggatcttcccgtccacttggtacttacggatgccagggtttagggagaagcctttctatctaactccatacattgtccaaggccctctgtgccctcagccagccctgtaaggccagcccaacacctgccccaccgctgagatgggtggcagatggcccacaggggcctgtctgattcagcgtgagccccttcgtggagcagggctccctctgtgcactgtgtacaggcgctgctggccctgcccaagagatgatgctctgttggggtgggtgagcagagttcaaggaagcccaagtaggagatttgggaaacatgccaaggtaagagagagcctggaccactctcctacagccccaagtcagtcactgtgctaatggtgaccgggaagggaagtcagggtctggggcccaaagaacgggcacacccagccatgagtttttcctgaagcacttgacccctgggaaatgtgaacggggagatgctggaagatggctcagcagacaggccagcccagctccagtgtccaaaaagcggtttctccaataaggaggcctgggaagggaagcacaatcttccccaaaggagaaccaagggctgaggttctgcccctccaggaagtaaggtgctctcggggcctccttggacttgtctgggggctgcagtggagtcagctggacacctgctccacccctgccacctccgcccccaccctctgcagcatctggcatctccatggcagcacatctgcagctgccggcctgtgatcgtgccgcacagctttcttttctttcctctcatcttttttttttttttttttttaaataacttcatccctttccctctctgctgagcatttaaccatttaaggaagttcccagtttgcattagggaattatttaagcccagcccagtgagggattatttgggaggaagcaggagtgagtaaaaacattgtgtctgtgtatatattgcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctggaagcccaggcctgcagctgtggaactctagattttttcaggacacgtctctttgcccttgtttacatatctactggcacagccgaggctcccaaccgtcctcccagaaacctggccacattagaaaggggtggtgggccctgccctttgtagaaagagtgggaccctttctggcctgtgattttccgtgccagtgatgccagggcccctgcctgtgggactccacccaaagcaggttcacaccaggacacacctggcacctttggcattgcctccttgtgccctaagcaatctcccagtgttgcacccaggagcccatgctgggcacaccagggctttccccttcctggctgcgcctccagagttgacgtcagctccacacccacactgccaagacaaaccaaaaagatgctctgggctccagaaccaccatcctcctagggctccagagagtttgcaaacccaggctgcctccccttctgtccatccctcaccccccggcccccaaaactcctacccccaaacctggcactgccgtgatttagaggaaacaaggacacagcgggggctgcccccacctggtgcacgctgcctcaaggccttctgttgctgcccacgcctccctgggcagtgcttctaaaggtgccagagcctcaccacagtgccactctggctgggcaggggcttccctcagcttcccagagtgcacatctgaaggtgcctaccctgggtgaggggctggtgggcaggaaggtaaaggggagaccatctgagcagccgccacccgctccccagtgcctctgtatggccctatccagggacacccatgggcatgcgcacatggcaatcctgaccaccacctgagcacaggtgccccctcgggaccaccccccttctctttgtttccatcagaataaccaaaagcatttaaacgtgttacctttctccatccatctagactccagaaacaaaaatcaacacaaatctttattttttgatttaaaagatataacaaaaaattatggggagagtattcattatggcaggtgtctgtctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaacttttttttttgg

SEQ ID NO: 6057 - DNA, 10721 bp, Homo sapiens
atgtgggggcttttgatctggacactgctagctctgcatcagatccgcgcggccagagcccaagatgatgtgtccccgtatttcaagacagagcctgtgcggacacaggtgcacttggaaggaaaccgcctggtgcttacatgcatggccgagggcagctggccactggagttcaagtggctccacaacaacagggagctgaccaagttctccctggaatacagatacatgatcaccagcctggaccgcacccacgctggcttttaccgttgcatcgtgcggaaccgaatgggggccctgctgcagcggcaaaccgaggtccaggtggcctacatggggagctttgaggaaggtgagaagcaccagagcgtctcccacggagaagcagctgtcatccgtgccccgcgcatcgccagcttcccccagccacaggtgacctggttccgggacggccgcaagatcccgcccagcagccgcatagccatcacgctggagaacacccttgtcatcctgtcaacggtggcccctgacgcaggtcgctactatgtgcaggctgttaacgacaaaaacggggataacaagaccagccagcccatcacgctcaccgtggagaatgtaggggggcctgcagaccccatcgcacccaccatcatcatcccacctaaaaacaccagcgtggtggccggcacctcagaggttaccttggagtgtgtggccaatgccaggcccctgatcaagctacatatcatttggaagaaggacggggtattgctgtcgggcggcatcagtgaccacaaccgccggctcaccatccccaaccccaccggcagtgacgccggctactacgagtgtgaggctgtcctgcgcagcagcagcgtcccctctgttgtccggggcgcctacctctcagtgctggaaccgcctcagtttgtcaaggagccagaaagacacatcactgcggagatggagaaggtggtggacatcccctgtcaggccaaaggtgtgccgccgccctccatcacctggtacaaggacgcagccgtggtggaggtggagaagttgacccgcttccggcagcgcaacgacgggggcctgcagatcagcggcctggtgcccgatgataccggcatgttccagtgcttcgcccgcaatgcagccggcgaggtgcaaacttccacctacctggctgtcaccagcatcgcccctaacatcaccagaggccccctggacagcacggtgatcgatggcatgtcagtggtgctagcatgtgagacctcgggggcgccccgaccagctatcacttggcagaaaggggagcgcatcttggccagtggctctgtgcagctgcctcgcttcacacccctggagtcgggcagcctcctcatcagccccacacacatctccgatgcggggacctacacctgcctggccaccaactctcggggggtcgatgaggcctcagcagacctagtcgtttgggctcggacccgcatcaccaagcccccccaggatcagagtgtcatcaagggcacccaggcctccatggtgtgcggagtgacccacgacccccgagtaaccatcaggtacatctgggagaaggacggggccaccctgggcacggagagccatcctcgtatccgcctggacagaaacggctccctgcacatctcacagacgtggtcgggagacatcggcacgtacacctgccgggtgatctcagcaggaggcaacgactctcgcagtgcccacctgcgagtcaggcaactgccccacgcgcccgagcacccagtggccactctcagcaccgtggaaaggcgagccatcaacctgacgtggaccaagccctttgatggcaacagccccctgatccgctacattctggagatgtcggagaacaatgccccctggactgtactcctggccagtgtggaccccaaagctacctcagtgacagtcaagggcctggttcctgcacgctcctaccagttccgtctttgtgccgtcaacgacgtggggaaaggacagttcagcaaagacaccgagagggtctccctccccgaggagccccccacggcccctccacagaacgtcatcgccagcggtcgaaccaaccagtccatcatgatccagtggcagccgcctcctgagagccaccagaatggaattctcaagggttacatcatcaggtactgcctggccgggctgcccgtggggtaccagtttaagaacatcacggatgctgatgtgaacaacctgctgctggaggatctcatcatttggaccaactacgagatcgaggtggctgcttacaacagcgctgggctgggggtctacagcagtaaagtcaccgagtggacgctgcagggagttcccacggtccctccgggcaatgtgcacgcggaagccaccaattccacgaccatccgcttcacctggaacgcccccagcccccagttcatcaacggcatcaaccagggctacaagctgatcgcctgggagccggaacaggaagaggaggttaccatggtgaccgcccggcctaactttcaagacagcatccacgtgggcttcgtgtctggcctgaagaagttcaccgagtacttcacctcagtgctgtgtttcaccacccccggggacgggccacgcagcaccccgcagctggtgcgcacccatgaggatgtgcctgggcccgtgggacacctgagcttcagtgagatcctggacacatcgctgaaggtcagctggcaagagccgggagagaaaaatggcatcctcacagggtaccggatctcctgggaggagtacaatcgaaccaacacccgtgtgacccactacctgcccaacgtgaccctggagtaccgtgtcacgggcctcaccgcgctcaccacctacaccatcgaggtggccgccatgacctcaaagggccagggccaagtgtccgcctccaccatctcctctggggtgcccccagaactcccagggccccccaccaacctgggcatttccaacatcggcccccgctctgtgaccttgcagttcaggccaggctacgatgggaaaacctccatctcccgctggctggtggaagcccaggtaggcgtggttggggagggagaggagtggttgctgatccaccagctctccaatgagcccgatgcccgctccatggaggtgcccgacctcaaccccttcacctgctacagcttccgcatgcgccaggtgaacatcgtgggcaccagcccccccagtcagccttctagaaagatccagaccctgcaggcaccccctgacatggccccagccaatgtgtctctgcgcacagccagtgagaccagcctgtggctgcgctggatgcctctcccggagatggaatacaatgggaaccctgagtccgtgggctataagatcaagtacagccggtcagacgggcatggcaagacgctgagccacgtggtgcaggaccgtgtggagcgggactacaccatcgaggacctggaggagtggacagagtaccgcgtccaggtccaggccttcaacgccatcgggagcgggccctggagccagacggtggtgggcaggacccgggagtcagttccctcttccggccccaccaatgtgtctgcactggccaccacctccagcagcatgctggtgcgctggagcgaggtccccgaggctgatcgcaacgggctcgtgctgggctataaggtgatgtataaggagaaggactcggacacccagccccgattctggctggtggaaggcaactcgtctcgcagtgcccagctcaccggcttgggcaaatacgtgctctatgaagtccaggtgctggccttcacacgcatcggggacggcagccccagccaccctcccatcctggagcggacgctggatgatgtcccaggaccacccatgggcatcctgttcccagaggtgcggaccacgtctgtgcggctgatctggcagccccctgccgcccccaatggcatcattcttgcttaccagatcacacaccggctcaacaccaccacggccaacaccgccactgtggaggtgctggcacccagcgcccggcagtacacagccacgggcctcaagccagagtctgtctacctgttccgcatcacggcccagacccgcaagggctggggagaagctgccgaggccttggtggtgaccaccgagaagagagaccgtccgcagccccccagcaggccgatggtgcagcaggaggatgtgagagcacgcagcgtgctgctgtcctgggagccagggagcgacgggctctcccctgtgcgctactacaccatccagacccgcgagctgcccagcggcaggtgggcactgcactcggcctccgtgagccacaatgcctccagcttcattgtggacaggctgaagcccttcacgtcctacaagttccgagtgaaggcgaccaatgacattggcgacagcgagttcagcgaggagtcggagtcactgaccaccctgcaggctgcccccgatgaagcacccaccatcctctccgtgacgccccacaccaccacctccgtgctaatccgatggcagccgccagcagaggacaagatcaatggcatcctcctgggcttccggatccgataccgggagctgctctatgaaggactgaggggcttcacgcttcgaggcatcaacaacccaggggccacatgggctgagcttacctccatgtactccatgcggaacctgagccggcccagcctcacgcagtacgagctggacaacctgaacaagcacaggcggtacgagatacggatgagcgtgtacaacgctgtgggtgaggggccctccagccccccgcaggaggtctttgttggggaggcagtgcccacagcagcacctcgtaacgtggtcgtccacggcgccacggccacacagctggacgtgacttgggagccacctccgctggacagccagaatggagacatccaggggtacaagatttatttctgggaagcccagcgggggaacctcacagagcgagtgaagacgcttttcctggctgagaacagcgtgaagctcaagaacttgactggctacacggcctacatggtcagcgtggccgccttcaacgccgctggggatgggcctcggagcacccccacccaaggccagacccagcaagcagcccccagcgctcccagctcggtcaagttcagtgagctgaccacaacctcagtgaatgtgtcctgggaagccccgcagttccccaatggcatcctggagggctacaggctggtgtacgagccctgcagccccgtggatggagtcagcaagatcgtgaccgtggacgtgaaggggaacagccccctgtggctgaaggtgaaggacctggcggagggggtgacctacaggttccgcatcagagccaagaccttcacctacgggccggagatcgaagccaacgtcaccacgggccccggagaaggtgccccaggaccgcctggcgtgcccatcatcgtgcggtacagctctgccatcgccattcactggtccagcggagacccgggcaaagggcccatcacccgctacgtcatcgaggccagaccttcagacgagggactatgggacatcctcatcaaagacatccccaaggaggtgagctcctacacgttcagcatggacatcctgaagccgggcgtgagctatgacttccgggtcatcgcggtcaacgactatggtttcggcacccccagcagcccctcccagtctgtgccagcccagaaagccaaccccttctatgaggagtggtggttcttggtggtcattgccctggtcggcctcatcttcatcctgcttctggtcttcgtgctcatcatccggggccagagcaagaagtacgccaagaagacagactcggggaacagtgccaagtctggagccctaggccacagcgagatgatgagcttggatgaaagcagcttccctgccctggaactcaacaacaggcggctctccgtcaagaactctttctgccgaaagaacggcctgtacaccaggtctccccccaggcccagcccaggcagcctgcactactcggatgaggatgtcaccaaatacaacgacctcatccctgcagagagcagcagcctgacggagaagccctcagaaatctccgactctcagggaagtgacagcgagtacgaggtcgactcaaaccaccagaaggcccactcctttgtcaaccactacatcagtgaccccacatactacaactcgtggcggcgacagcagaagggcatctcgagggcacaggcctacagctacacggagagcgactcgggtgagccagaccacaccaccgtcaccaacagcaccagcacccagcagggcagcctctttcggcccaaggccagtcggactccaacgccccagaacccccctaaccccccaagtcagcagagcaccctctaccgtccccccagcagcctggccccaggctcccgggctcccatagcaggattttcatcatttgtttgacatcagaagaggaaaaagcagaaagagaaatggcaccaaactcctccttcacccctcctctcactgcctgccagaaaacaaaaacaccaagaaaccaagtcaacttttcacctcctgagtttatttttccagagattccagggccagcaaagccggcgttcagaaggagggagaaaaccgtgagaggatgtgtgtggccagcagctcttcagctttgagatggtggggttcactgctcccttgggaattacacggagctggggaagtggctgtgtcactgctatggacacggagtggggcgggcatctggagagagagagggagcggaggctaaggactggaggccgccaggcaggcgtggccgagggaagaaaaagcttctggatgtccagccagctgcccccttccagcccctccaggacccctggacccactgccgctgctctctgcaaaaagaatgggcatcccggaggccacgcctatcttctctctctgctcctccttccctccatgcaccatcactgtggctggcaggcatcggacagcctcatccagaccccctgccctgtcttggcaacctctactgcccatctcccctgctcaacttctccaccaagcatttggtttatttagaaaaaggaagaaaaacaaaaaacaaaaaactaaagggtgagaatttgcttagcgccttccttgttcctgcatattttttaaaatattgaatccaaggaagagagcccaagggtaggggagaaaccccccacaactgacccctgcctccctgtgctggaattgactttcctgagcatggacaaggaaaggtgaagtctggggagcagaggtgtaaataaggcgactggccttggcactgtgggatgattaggtttaacgcattgtgggcaagataagaatgacactttgactgttctctttcttccaatccaggttccatccgtcctctctttaaaggggtagtcagcttcccaaggctggggagtggggcacagctgagggatctccctctgggcagacacgtcactctccactggatagatcctcaccacacacacacacacacacacatctcccatgcacttacaaggaacagggtctagggatcctctccagaacaaactcatctgggccctcctagccagacagcacactcactttcagatctgtgtccctctcactgccacccggcagcctcctaagcacagaggcacaggagcccagaggggtggcccaagtccctggtccagaggctggaatacccagagtttgctcagtcagcctagcacccagtttacaggcaaaaaggcaaagacaccctaacccccagtaacagcttccaggctgggctccgcctggccagggcggggaggggaaggggcaggtcaggaagctcagtccaaagtggacccagcatttgaattgcacgcccagcaggggcaggtcagatgggaccaagtgacaagaatagctgatgggagggaatgcttttacacacacacacacacacacacacacacatacacatacacaatctgctccaaggagtgttctgcaaaaagccacatccagtggccaggatcttcccgtccacttggtacttacggatgccagggtttagggagaagcctttctatctaactccatacattgtccaaggccctctgtgccctcagccagccctgtaaggccagcccaacacctgccccaccgctgagatgggtggcagatggcccacaggggcctgtctgattcagcgtgagccccttcgtggagcagggctccctctgtgcactgtgtacaggcgctgctggccctgcccaagagatgatgctctgttggggtgggtgagcagagttcaaggaagcccaagtaggagatttgggaaacatgccaaggtaagagagagcctggaccactctcctacagccccaagtcagtcactgtgctaatggtgaccgggaagggaagtcagggtctggggcccaaagaacgggcacacccagccatgagtttttcctgaagcacttgacccctgggaaatgtgaacggggagatgctggaagatggctcagcagacaggccagcccagctccagtgtccaaaaagcggtttctccaataaggaggcctgggaagggaagcacaatcttccccaaaggagaaccaagggctgaggttctgcccctccaggaagtaaggtgctctcggggcctccttggacttgtctgggggctgcagtggagtcagctggacacctgctccacccctgccacctccgcccccaccctctgcagcatctggcatctccatggcagcacatctgcagctgccggcctgtgatcgtgccgcacagctttcttttctttcctctcatcttttttttttttttttttttaaataacttcatccctttccctctctgctgagcatttaaccatttaaggaagttcccagtttgcattagggaattatttaagcccagcccagtgagggattatttgggaggaagcaggagtgagtaaaaacattgtgtctgtgtatatattgcacatgaggtcaattttcctttgcctttaatgaatcacctggtgcactaagatattccacccccccactccccacacgctcattcgcacccatgctgacacctacgtgtacatgcgggatggtgcccatgcacgcctgtgcttacacacatgcacacacaaatatgcacagaacacacatctgtatgtgtgttagcaaagagactcctgaactccctctgatggctgaagccatctctcccctgtgaggcacaggtggcctgggttgcttgcacttggggcgtggctgggatctattgtctgagagggtgaggacaccacgcaaatttagacaagcccatgagatcaggctgggcccatggtgaaagtcccacacttagtcaatacccactcatctggaatattgtctccacagccccagccacagctggaagcccaggcctgcagctgtggaactctagattttttcaggacacgtctctttgcccttgtttacatatctactggcacagccgaggctcccaaccgtcctcccagaaacctggccacattagaaaggggtggtgggccctgccctttgtagaaagagtgggaccctttctggcctgtgattttccgtgccagtgatgccagggcccctgcctgtgggactccacccaaagcaggttcacaccaggacacacctggcacctttggcattgcctccttgtgccctaagcaatctcccagtgttgcacccaggagcccatgctgggcacaccagggctttccccttcctggctgcgcctccagagttgacgtcagctccacacccacactgccaagacaaaccaaaaagatgctctgggctccagaaccaccatcctcctagggctccagagagtttgcaaacccaggctgcctccccttctgtccatccctcaccccccggcccccaaaactcctacccccaaacctggcactgccgtgatttagaggaaacaaggacacagcgggggctgcccccacctggtgcacgctgcctcaaggccttctgttgctgcccacgcctccctgggcagtgcttctaaaggtgccagagcctcaccacagtgccactctggctgggcaggggcttccctcagcttcccagagtgcacatctgaaggtgcctaccctgggtgaggggctggtgggcaggaaggtaaaggggagaccatctgagcagccgccacccgctccccagtgcctctgtatggccctatccagggacacccatgggcatgcgcacatggcaatcctgaccaccacctgagcacaggtgccccctcgggaccaccccccttctctttgtttccatcagaataaccaaaagcatttaaacgtgttacctttctccatccatctagactccagaaacaaaaatcaacacaaatctttattttttgatttaaaagatataacaaaaaattatggggagagtattcattatggcaggtgtctgtctgtaagaaaaaaatatatatctctatgtcatatagcgtgttagcaggtttattttttaaatgaaaggtaagaaagaaattgatttgaaatatataccacaagaagtcccgtgtcctgtcaaactgtcagtattttataaataaacttttttttttgg

SEQ ID NO: 6058 - DNA, 4231 bp, Homo sapiens
ggcgcggtcgctaagccagaagcggagtcgcgggcgcggggcggggcctggacccgggcctggacccggagggcgggtccctgggcctcgtagctcccgggcccggacgcgcgctcacaggcgcgcgcgaggacgcgctccggggacgcgcgaggacgccgtggcgggagaagcgtttccggtggcggcggaggctgcactgagcgggacctgcgagcagcgcgggcggcagcccgggggaagcgtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattccattaatgaggcaaagggaactcaaagttggcattcccgtcacggatgagaatgggaaccgcttgggggagtcggcgaacgctgcgaaacaagccatcacgcaagttgtcgtgtccaggattctcatggcagcccctggcatggccatccctccattcattatgaacactttggaaaagaaagcctttttgaagaggttcccatggatgagtgcacccattcaagttgggttagttggcttctgtttggtgtttgctacacccctgtgttgtgccctgtttcctcagaaaagttccatgtctgtgacaagcttggaggccgagttgcaagctaagatccaagagagccatcctgaattgcgacgcgtgtacttcaataagggattgtaaagcagggaggaaacctctgcagctcattctgccactgcaaagctggtgtagccatgctggtgagaaaaatcctgttcaacctgggttctcccagttacggaaaccttttaaagatccacattagccttttagaataaagctgctactttaacagagcacctggcgtgggccaagtgcctgatactcccttacactgaatcatgttatgatttatagaaatacctttcctgtagcttttatagtcattgtttttcaaagacgatataccagccctcacccaggttttaaaaaagcactggtaggcatagaataggtgctcagtatatggtcagtaaatgttctattgattatcaatcagtgaaaaaagaaatctgtttaaaatactgaattttcatctcactcccattgcaaatcaaggagatctcagcagtgaactgggaaaatacaaaagctctgggctaatctataaaaacttaccctgaaatattaagggcagtttgcttctagtttggggattgcgctagcccaatgaaggtgatgaagcttttggatttggagggtaaaagctccttcacaccccttccaaaagtcagtcacagaccactgcaacatgccttccctgctggatcattatatacattcagattgtgagtggattgccttggttgacttttaatttattgttttttgttcttataaagatgataatcttaccttgcagttattgactttatattcaattatttacatcaaataatgaaataactgaaatgtacaaatgtcaaattttggaagtatattcaataccaatgctgtatgagtgggctgaatccagttcattgttttttttttggtaagaagtgagactacagttccagctacctacatgtcttttcttgtcatccttatagatctctttggctttcagaaagatacagtgataatgtgtgtatgaatcagtcacaatgaattttacttgaatattgtatgttgcattccacttcatttgaaaataatgaaaccatgtaccactgtttacatcatctgtagtgatttcatagataatatatttaatatgacagattatgtttcaactctgtagatgtttaacgtcatagacagttggccctctgtatccgtgagctctatatctgtgaattcaaccaagtttggatggaaaattttttttttttttttttttttgagacggagtctcgctctgtcacccaggctggagtgcagtggcgtagtctcggctcactgcaagctccgcctcccgggttcacgccgttctcctgcctcagcctctctgagaagctgggactacaggcgcccgccaccacgcccggctaatttttttgtatttttagtagagacggggtttcactgtggtctcgatctcctgacctcgtgatccgcccgccttggcctcccaaggtgctgggattacaagcgtgagccaccgcacccggcctgaaaatattttctaaaaagataaaaaatatacataacgatgaaaaataatacaaatttaaaaaccaatacagtataacaactatttacatagtgcttacattgtattaggtgttataagcaatctagagatgatttagcaagtatacaggaggatgtgcctaggttatatgcaaatactgtgccattttatatcaggaacttgagcatctgcagatattggtatcggagggcggtcctggaaccaagcatccacggatactgaggggtgacatttcatgaagtgtagatcattgtattcagagattgtaaatgaaaaaaatatagaaactatttagttttggtagattttttttctgacaatgtgaccagactgaatttcctcataaagaaaaaatggcgtgccttgtgtctgtgtttctcttttctctgaaaggattaatagatctgaagctttgggccactcagagccttccttgatgctgccagagtcttcttatttagattttctgtcttaaaccattggaagcaaaacggttttcccatgacattctggccttggacagattctgttgtcctcgacgcgtctctttataaagtggtaaaagcctgaaattcagggcagctctccatgaggtgctgaagggctcttttcataagaagctaaggcactgctgcctgccccaggtgtcccgctcctctcagagtcctccccctaccaggtagtgtgtagctccatttcagaatgttaacctccagtgaagagctaatgactggttagaagattgacaaactaaccaaaattttacacactccggttatgtgtgtgaaaggttataaaaggaatggccgggtgcggtggctcacccctgtaatcccagcactttgggaggccgaggcgggtggatcacctgaggtcaggagtttgagaccagcctggccaacatggagaaaccccgcctctactaaaaatacaaaaaattagccaggcatggaggcacatgcctataatcccagctactcgggaggctgaggtaggagaatcgcttgaatccgggagctggaggttgcagtgagccaagatcgcaccattgcactccagcctgggcaacaagagcgaaactccatctcaaaaaaaaaaaaaagagattataaaagggatgatgaacatggagctgcatctttttaaacgttgttttttgatgcttcagactcttaatgcttttatataaagctatcaactgtatgttgatcacagtttataagaaagaacaaatcaagattggcaatccttgccgatcttttagaaataccttttctggagaaaaaaaaatccacatgaagtgcaataagcttataaagctaagtagttattaatatttctattaacatgatacaaaggatgatgattgtaagtgtttactgactggcagcttttatttcagtattagcacagcgtcttgccagtgttggaggccatgtattatttcagttcaactggatgaaatgttaaataaactcagaatgaaaataaa

SEQ ID NO: 6059 - DNA, 796 bp, Homo sapiens
cactgagcgggacctgcgagcagcgcgggcggcagcccgggggaagcgaggcatggtcttgctttgtcacccaggctggagtgcagcggcatgatgatagctcactacagctccaactcttgggctcaagcgatccccacaccccactgccacctcagcctcctgagtagctgcaactataggcgtgcaccaccatgcccggataatccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaatgagttgggaacagcttacgtttctgcaacaactggtgccgtagcaacagctctaggactcaatgcattgaccaagcatgtctcaccactgataggacgttttgttccctttgctgccgtagctgctgctaattgcattaatattcc

SEQ ID NO: 6060 - DNA, 572 bp, Homo sapiens
ctcactctatcacctaggttggagtgcagtggcacaatctcagccgactgcaacctccacatcccaggctccagcaatcctgctacctcagcctcctgagtagctgggaccatacgccaccatgcccagtccgggaccatgtctggagaactaccaccaaacattaacatcaaggaacctcgatgggatcaaagcactttcattggacgagccaatcatttcttcactgtaactgaccccaggaacattctgttaaccaacgaacaactcgagagtgcgagaaaaatagtacatgattacaggcaaggaattgttcctcctggtcttacagaaaatgaattgtggagagcaaagtacatctatgattcagcttttcatcctgacactggtgagaagatgattttgataggaagaatgtcagcccaggttcccatgaacatgaccatcacaggttgtatgatgacgttttacaggactacgccggctgtgctgttctggcagtggattaaccagtccttcaatgccgtcgtcaattacaccaacagaagtggagacgcacccctcactgtcaa

SEQ ID NO: 6061 - DNA, 2568 bp, Homo sapiens
ggcgggagcctcccggcctgggattggtcgaaaaggaggggcgtggggcgggcgtgggggcagttccccagcccaggtcctcctctcacccgggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacatcacggacccccgcactgtctttgtatctgagcgggagctggactgggccaaggtgatggtggagaagagcaggatgggggttgtgcccccaggcacccaagtggagcagctgctgtatgccaagaagctgtatgactcggccttccaccccgacactggggagaagatgaatgtcatcgggcgcatgtctttccagcttcctggcggcatgatcatcacgggcttcatgctccagttctacaggacgatgccggcggtgatcttctggcagtgggtgaaccagtccttcaatgccttagtcaactacaccaacaggaatgcggcttcccccacatcagtcaggcagatggccctttcctacttcacagccacaaccactgctgtggccacggctgtgggcatgaacatgttgacaaagaaagcgccgcccttggtgggccgctgggtgccctttgccgctgtggctgcggctaactgtgtcaatatccccatgatgcgacagcaggagctcataaagggaatctgcgtgaaggacaggaatgaaaatgagattggtcattcccggagagctgcggccataggcatcacccaagtagttatttctcggatcaccatgtcagctcctgggatgatcttgctgccagtcatcatggaaaggcttgagaaattgcacttcatgcagaaagtcaaggtcctgcacgccccattgcaggtcatgctgagcgggtgcttcctcatcttcatggtgccagtggcgtgtgggcttttcccacagaaatgtgaattgccagtttcctatctggaaccgaagctccaagacactatcaaggccaagtatggagaacttgagccttatgtctacttcaataagggtctctaaatgccccacttcagcaaggaccagtctattcccatattcaccagctcctccttagctacgtgcacacttgtgtcctccttcccctttgccaacaaggcctgaaggccagggtagattggggggtgggacaatgaatgcctcatacttacaccctggtactggttgattggacctcaggggaaaaaagtgaaaaagggtagcaaaggccaatgtcttctagctgcttcctcaacccctgtcccctggagaccagaagctgaggccctctcagggaggagacatccaagcaaatcatttggaaaagttaggaaacctttaggattctggttccagccagggttgaggaaaagaccttggatcaaaaggaagcttctatacctctttcttcttcgcttcctcctctcccaagcaatggaaacttttacccatgtaattctagctgaactcaggaaaaagaagggggaaaggactctgtccccttggggctcatcacccttccacatcctcctcctcgttgccccctggtcaggcagcttcttttttttttttttcaagatggagtcttgctctgtcgcccaggctggaatgcagtggcgcgatctcggctcactgcaaactctgcctcctggattcaagcgattctcctgcctcagcctctcaagtagctgggattacagggcacctgccaccacgcctggctaatttttgtattttagtggagacggggtttcaccatgctggccagactggtctcgaactcctgacctcaggtgatccgcccgcctcagcctctgaaattgctgggattacaggcatgagccaccacacccagcccggacagcttctttgggagtgctgctaaccttgaaattatcagacacttaggagttattagtgctaaaaaggggaccgtgcaaggcagcagagttacatggttcttcaaatcatgtctgaacctattcttggaatcttctctataataagggaagttctcttaccccactgccacatacctctgttttaaaagataagtccactaactgtgagtaaaaatgatatatataggcattaaccacacactttaatgggtataatttcctggctgcctcccttcctcagcccattaggttaaacaccaaagaaagactggtgtgtactgaataggaaagggaagttttatttggaaccttctaagaggaaatcaaccaggaccaaagagccttaaaggacacacagcaatgcacagccacttcccttccccagcttggctgccctaggtgatttctcaagctccttgggggactgttgtttctcatctggaatcaatgtgtgtatgagttttgtctggtaggattgctgactctgtccaacagatatcactgtgaattgaataaatttgttgaaagagcacacaggcacacatacacacaaa

SEQ ID NO: 6062 - DNA, 3089 bp, Homo sapiens
ggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtct

SEQ ID NO: 6063 - DNA, 3095 bp, Homo sapiens
attccggcacctcccttaggcgccagggacagccgagcgttacctggtcccgggcagcggagttctttacccaccccagttctggttctgacgccctagctcattccgcaaatttagggcttgggtctggcttgttcccctccggctcgaaccacctcttctctgagccgagccagctaccggggctcctggaattgccacccctccctgggcacccttgaggcctccgtggagggacgtcacggggcagagcgggacgtgagcctgagtttgctgcaggcgtgctctgtgtggtggctgggttctgccaatccccgtgcccaccgggtgggcgcggccgggaagctcctgcccctccctgctggtcggcgtcacgcgtgacgtcccgcgtgatggctgggagggcccggcggcgacagcggaggcagagaggaaggcggttctgagagcttcagagagcgatggaaagcaaaatgggtgaattgcctttagacatcaacatccaggaacctcgctgggaccaaagtactttcctgggcagagcccggcactttttcactgttactgatcctcgaaatctgctgctgtccggggcacagctggaagcttctcggaacatcgtgcagaactacagggccggcgtggtgaccccagggatcaccgaggaccagctgtggagggccaagtatgtgtatgactccgccttccatccggacacaggggagaaggtggtcctgattggccgcatgtcagcccaggtgcccatgaacatgaccatcactggctgcatgctcacattctacaggaagaccccaaccgtggtgttctggcagtgggtgaatcagtccttcaatgccattgttaactactccaaccgcagtggtgacactcccatcactgtgaggcagctggggacagcctatgtgagtgccaccactggagctgtggccacggccctgggactcaaatccctcaccaagcacctgccccccttggtcggcagatttgtgccctttgcagcagtggcagctgccaactgcatcaacatccccctgatgaggcagagagagctgcaggtgggcatcccggtggctgatgaggcaggtcagaggcttggctactcggtgactgcagccaagcagggaatcttccaggtggtgatttcaagaatctgcatggcgattcctgccatggccatcccaccactgatcatggacactctggagaagaaagacttcctgaagcgccgcccctggctgggggcacccctgcaggtgggactggtgggcttctgcctggtatttgcaacccccctgtgctgtgccctattcccccagaagagctccatacacataagcaacctggaaccagagctgagagctcagatccatgagcaaaaccccagcgttgaagtggtctactacaacaaggggctttgaggagggtcagcctctgtcccctccctcacttccttgggctgctgctttagtggagtcatgtcacccctaccacttggctatctgcctagcactgggcaggggccttggtgggcagatggcaattgagggtagcaacctattagggtgggggagggacctccataaggcttttcctcccttctctggtttcaaagatcagagcacataacccctcctgtgcttgagtgtccatgcatatacatacatgatacacatgtgtatgtgtacattgggtcctgaaagctagaagcaggcatgctagcctagtatgttctgacatctggcttcccttctcagcctcatgtccacctgcctgccagccaggctacaggtgtgacttccttctctaaactgttacaccagccaagttatttttgatggcacctcatcccttctagaaataggaggagccccaggatctcaggacagagacttatagacactagtaggacaaagcgggctgaatccttcaggtttctgatacctagctccccaagctgactgggctggcagaggagaacatgttgagacaagggaggcaggggacttatgcatccctcagtgccatcccttgtatcctggaatagctccatttcccctcctcctctctaccagacaaaggagtgcctgtgtcctgtactgccctcgctgtctcccccaccaccctacttgacagcgtgggcatcttcaggcacagccttgggagttcctggtgtgctctgacatcatgacctcaaatctaaatcctccaatcccaactccctttcccaaacaaaaagccacagaggcagagcaagcattcccctttaagagcttccactgcaccccctcccaagggacacagcggtaggaatggtgcttaaactccacaggtatcagagagggtgtaactaggacatcctcaagggcagctaggccccgaatgtacaatgttaagacagggaattttgtgttccattgacttttttttttttttttaatggagtttcactattttgcccaggctggagtgcgatggtgcgatcttggctcactgcaacctctgcctcctgggttcaagtgattctcttgcctcagtctcccgagtagtggaaattacaggtgtgtgctaccacatcttgctagttttgtatttttagcagagatgggggtttcaccatgttggccaggctagtctcgaactcctgacctcaggtgatccacctgccttggcctcccaaagcactgggattacaagcatgagccactgtgcccagcctgttccactgacatttcttagacattcagcaaaacccccaccttaacctcttttctttcttgagggttggtcctgtccccacctccaccctcccaccccctggaagaggaagggcccgggcatcagtggctagtccaaataaaatatgggcttggggatggaatgggtggtggtaagttcacagagtgtagttagatcccaactcccatgacctctggcttcagtggtgggtggggcagggcagatgaaagggcttcagtgggaacctctgagagcattttcctgttccccctatcaaccgcccccagtgataacatctgtgaagccagccattactcaataaactgcaaacttgtcta

SEQ ID NO: 6064 - DNA, 1315 bp, Homo sapiens
ctctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttg

SEQ ID NO: 6065 - DNA, 1363 bp, Homo sapiens
gccactctaaccagcgcaaaatgtccctggaacaggaggaggaaacgcaacctgggcggctcctaggacgcagagacgccgtccccgccttcattgagcccaacgtgcgcttctggatcaccgagcgccaatcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttgaggatttgaagaaagaa

SEQ ID NO: 6066 - DNA, 1133 bp, Homo sapiens
gtgcgcttctggatcaccgagcgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcggcaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaaggatacaagaagcttggaagcggagtcttgcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctg

SEQ ID NO: 6067 - DNA, 975 bp, Homo sapiens
tctcccctggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttaggagtaatccctcagtttgtccagatgaagtatggcctgactggcccttggattaaaagactcttacctgtgatcttcctcgtgcaagccagtggaatgaatgtctacatgtcccgaagtcttgaatccattaaggggattgcggtcatggacaaggaaggcaatgtcctgggtcattccagaattgctgggacaaaggctgttagagaaacgctagcatccagaatagtgctgtttgggacctcagctctgattcctgaagtcttcacctacttttttaaaaggacccagtatttcaggaaaaacccagggtcattgtggattttgaaactgtcttgtactgtcctggcaatgggactgatggtgccattttcttttagtatatttccacagattggacagatacagtactgtagtcttgaagagaaaattcagtctccaacagaagaaacagaaatcttttatcacagaggggtgtaggcgtgagttttaggtgaatttatgtggttcctgcttgaaaaccttcccctctccaggttcggtttagagaactttgccacaggtcttctggggaccccagaggtgtctgtgctgacaaggcgacttcagattccatactgagatcgttcccaggctggcgtctctggggtttttaaggctggctggagaagacagtgggagggtgccccgtctgacacccctggggttgctgagggaacggttggagtggggatcggcctgcgaaaggatactgtgaaatcactaattaactaataaacctgtctcaagttg

SEQ ID NO: 6068 - DNA, 739 bp, Homo sapiens
cgccaagtacggcccgggcccggcgcgactaggggcagggagggggcgggccgggccgcgtggagtcgggctgacccgggtgaccttggccaggccacgtgggcgccccctgtctccgtttcctcctctcggagttgtgccgggaacgcgcaccaccggccttcaccccttagggcgcggcaggggacgcaggggaaatcgaagctgccagatgcccacgaccacaacgtcaccctccagattgccctctcggaggggcccagtccgcgcaggtggctgctccctactgcctgagctgtggctgagcagcagattggggagaaacaggctctcgcaccttgtcctttattcgacgatttcttcaatggacagaattattagatcctacaaatgtgttcatttcagttgaaagtatagaaaactcgaggcaactattgtgcacaaatgaagatgtttccagccctgcctcggcggaccaaagggcaacagtgcatcccgacagcagcaacctgatccccaagctttttcgacctgcagcgttcctgcctttcatggcacccacggtatttttgtcaatgacgccactgaaagggatcaagtccgtgattttacctcaggttttcctctgtgcctacatggcagcgttcaacagcatcaatggaaacagaagttacacttgtaagccactagaaagatcattactaatggcgggagccgttgcttcttcaactttcttagg

SEQ ID NO: 6069 - DNA, 4140 bp, Homo sapiens
aactacactccccacaacgccttgcgcctcccgctcgctgcggttgattagggccaatcgggagaggcagctgtggcgggggccgaggagggacattttaaaagggccggagattgcgggcgtcagtggccatggcggatacagcgactacagcatcggcggcggcggctagtgccgctagcgcctcgagcgatgcacctcctttccaactgggcaaaccccgcttccagcagacgtccttctatggccgcttcaggcacttcttggatatcatcgaccctcgcacactctttgtcactgagagacgtctcagagaggctgtgcagctgctggaggactataagcatgggaccctgcgcccgggggtcaccaatgaacagctctggagtgcacagaaaatcaagcaggctattctacatccggacaccaatgagaagatcttcatgccatttagaatgtcaggttatattccttttgggacgccaattgtagtcggtcttctcttgcccaaccagacactggcatccactgtcttctggcagtggctgaaccagagccacaatgcctgtgtcaactatgcaaaccgcaatgcgaccaagccttcacctgcatccaagttcatccagggatacctgggagctgtcatcagcgccgtctccattgctgtgggccttaatgtcctggttcagaaagccaacaagttcaccccagccacccgccttctcatccagaggtttgtgccgttccctgctgtagccagtgccaatatctgcaatgtggtcctgatgcggtacggggagctggaggaagggattgatgtcctggacagcgatggcaacctcgtgggctcctccaagatcgcagcccgacacgccctgctggagacggcgctgacgcgagtggtcctgcccatgcccatcctggtgctacccccgatcgtcatgtccatgctggagaagacggctctcctgcaggcacgcccccggctgctcctccctgtgcaaagcctcgtgtgcctggcagccttcggcctggccctgccgctggccatcagcctcttcccgcaaatgtcagagattgaaacatcccaattagagccggagatagcccaggccacgagcagccggacagtggtgtacaacaaggggttgtgagtgtggtcagcggcctggggacggagcactgtgcagccggggagctgaggggcagggccgtagactcacggctgcacctgcagggagcagcacgccaaccccagcagtcctgggccccctgggagagtgctcaacctacagtggagggagactgacccattcacattttaacataggcaagaggagttctaacacatttcgtacaaaaaaataatcaagtgcatttctgggccttatgtggggttgtcaaaactccactcagcacaattatgtgtgaagctgaaaaattgtagagtgcccatggggtagaagtagaatccttttatactttggttccttttttatttttattttttatcagaatcaaatctgagccttagtttcagctgaccagaagtggcaggaggacaggtggaggcgagccagattaggcctggagttgggctggtttggtggccaggctggtaaatttaggatattacaatggccagcccagatggctccctgggctggcatggggaggggagagaaggtggtctgcaccccacaggatgaactagccatgactagggtcctcaggcagtggcccagggaatcagggagcactggaggcctctgcaagattctgtgggcagctggctctgaatgtagccagcccacatccattccagagctgcagaaccagtccctctgagtgaagtccagtgaccctggagctagggtcccccttcgtggagctctaactgattcagggcccctgaagtgaccccagctccaggcaggaaaccccgagaaggaatggtgcttggcaggaaccatggacctgcacttggcctcttcgggaagatcctccttccaggccccaggctggatgctgggttctggggctgagagtggggctagactgggctggctgccttctgcggagcttctccagccaccaaggctgcctgccccatcccatccctttctaagcaggaaggtctcatgcctgagaatgcctaggccagctccttagacacctatcagagaagcagcatcaacctaggagcagtgggccctggctctgtcactaaatggcagtgagatgtcagacaaattcattcccttctctcagcctccactccctgtctgaaaccagaagactggatcaaggggttcccactggctcctccagcaagacctcgtctttgcttgtcctgctcagatgctggtcatcctgggcatgtccccagtgtggactctggactgggaagggggcaggcccctttggacctgcagttggcctcagcagaaggccttgccttgtgtatgtgactccatatcccgggagcagttgacctttgccaaacactttacagttctggaggaggaggtaacatagatgcctgggcctgatggtggggccatacccatgtgtcgcctctcactctggcagcctcagaggccccttgctgctggctcccatctccctcccatttgcagaccaggaaggaagagcaagctgtacaaagggaagcagagcctggggtgggtgtgagcagggtgacccctcatctgaaaggcccaaaccagggggaagcaccagcctcagtgcagccccctcctgaccccacctagaatggaagcctccacctgcagccccaggcctccctcccccggggtctccacctcaggggagacttaggccagaggtgaacattcatgtgtaggaagaggccgctgcagggtggcatcttagggtaggggaagtgtgctgaggtgggccttccatgggcatggccgttgcctctctgccagccgctggtgcccaccagctggctctgcagcacattgccctgaggggcctgccactctcctgaggagcagcccacctgctgcccgtgaggagggggagaagggttagacaagcctggaggacaaaacagcgggagtgtgggggtgccatggtgttggaggggcaggcctttttgagccaatcccaccataatgtgaatatgccagtgactgctgcgctgtgctggtctctaggcctgaactaggtgctggcatgtctgggtcgtcttttgaaaagctcacttcaagctcaccctgctcctacctatcataaggtcttattcttgtgcactttatcttgggaccaaaactgcctacccaccccttcccgccctccccctgccagaggcctggtgccctggcccagcctgtggcctcagcatctcataactcatttgctttgtctcccggatgatttccgtcatgctcccaaatgcagcttcaggtgagccaaggggtctgctcctgtggcggtgcagtggcaaaggatccagatagcctagggtgagggtgacagagggacagtgggctatgccactaggccctggtctggctttggaaagacctgtgaggggaaaccttcacccagcacccatgccccactctgctgaggccagaggaagggaggcctgaggggcagattggttcatgcctggggtggaggctaagcctggacacagtcagggcggggctggccagctgtgcgagaacacaagccacgcctgcgatggtgctgcacccctggtgtccctgcctggccctcctctggtcacttcaaacatgccctcaggcttggggatgcccttcttccattcccagacagcagtgtgagggtgcagggaccaagatgtcaagctggccgtggagtcgagctggccgacggacccctttcacctggttatgagccgacttctttggtgttctggcctctggcctgggaaaagggcaggagcctagaggaggaaaaaggctggtggacagacccagggtggtcttcaagcctggcccagtgagagtgaggcccccgcacgcaagcctcagccactcccaggggcctttgcagcgtctttttaacctcagaaaatttctcaatctatgtgatttgtgtaatactaatgagctttgggcaataaatacgggatttaaagca

SEQ ID NO: 6070 - DNA, 1274 bp, Homo sapiens
aggccccggagcccagcccgttgtctggccgcccgcgttccctgcacgctgggccgagcacacttgccctctagctccgtggcagccgcgcagccccactacgcccagccagcccgcagcggtaaccgctagagcgtcgcgccaagcaggcgccgcggggcagccctgccgccggggtcctcgcagggaaaaaggccgtcgccatggagacgcgggggcgccggcggccgttgggccgcgcaagtactgtcaaggacagttttcgggacgggggacgcggctccaggcacccaacagcactgacggcgaacacttcacgggcgcgcgatgcctcgacaaggcggccgccaccaccacctcagctgccctcgcgggcagcacggcgcggcaaaagcgcacgtcgcctagcgatggcgcggggcggggacacgggctgtaccggcccgtcggagacttccgcttccggggccgccgccatcgctctcccgggcttagaaggcccggctactgacgcgcagtgccagaccttacccctcacggtccttaagtctcggtcgccctcgcctcgcagcctgccacccgcgctcagctgcccgcctcctcagccagccatgctggagcatctgagctcgctgcccacgcagatggattacaagggccagaagctagctgaacagatgtttcagggaattattcttttttctgcaatagttggatttatctacgggtacgtggctgaacagttcgggtggactgtctatatagttatggccggatttgctttttcatgtttgctgacacttcctccatggcccatctatcgccggcatcctctcaagtggttacctgttcaagaatcaagcacagacgacaagaaaccaggggaaagaaaaattaagaggcatgctaaaaataattgaggttttcatgattcagcacctgcttttgtttctgtgagatgagctaaattgctttcataccccagataagagctaaaaccacctaatgctcttatggcacagctgtgtatagatttagttctctttatacttcatttctagcccagttgggttttgatttatataagtagtttagaccttctcttcataatcttgctctgagatggggaacagaacacacaagtatgaagtttctttcaggtgtaaataatgaaaaataaatgcctcataaatgatagtacaatgtaactatcaaagttttataattcattatgagttaaccattttaatgtttccaattaaacctcatagtgc

SEQ ID NO: 6071 - DNA, 2708 bp, Homo sapiens
agacaagtcggaggggagggagacgcagaggcggacaagatggcggcggcagctgtacagggcgggagaagcggtggtagcggaggctgtagtggggctggtggtgcttccaactgcgggacaggaagtggccgtagcggcttgttggataagtggaagatagatgataagcctgtaaaaattgacaagtgggatggatcagctgtgaaaaactctttggatgattctgccaaaaaggtacttctggaaaaatacaaatatgtggagaattttggtctaattgatggtcgcctcaccatctgtacaatctcctgtttctttgccatagtggctttgatttgggattatatgcacccctttccagagtccaaacccgttttggctttgtgtgtcatatcctattttgtgatgatggggattctgaccatttatacctcatataaggagaagagcatctttctcgtggcccacaggaaagatcctacaggaatggatcctgatgatatttggcagctgtcctccagtcttaaaaggtttgatgacaaatacaccttgaagctgaccttcatcagtgggagaacaaagcagcagcgggaagccgagttcacaaagtccattgctaagttttttgaccacagtgggacactggtcatggatgcatatgagcctgaaatatccaggctccatgacagtcttgccatagaaagaaaaataaagtagccaattctaaaagtagccctctttctcctggatcttgctgaattagtggcttggggggtgggggagataaaaagaacttaaaatgggtaaagtaagaaatgttaaaaagtccctgttttgtcctgaaattttagtctattctgggtaaataggattttctgacacagatatgagaagttgtagctctgatgtctagctgtagtctccttgatctgctgattgcattattttaatttgcttttctgggaaagcagttttgctaaaagctgtacagactttttcttttgtacctagcagtactttatatagtatagctttgggccatgtagcattttaagactcaattttaaaaaattattaatctgttgctgactcttaattcctatttcaatatgtgtttccttgaagaattcaggatacaacttcttgtgtatgacagctttccttcacacactatttttgtgggtgtgtatatatctgatttgggaagaatttaaaaaacacatagctttttaatttgtttgaaacagactttctgcctgttacatttttgcttttaaccaattaaagaagccaatggcattttagttttatattgtgttttccactagtatatccctgttgatttgtttgtgccttttattaactgccattttctaaaatttttttcaataaaaggaaggaagatgtgaaaaaaatggagtcatagttttgatggagagaacagagaaacaagtgttaacatctttctactataggtttttttcatttttaggctattttacttgtcaaaggcccctgagaacctgtagctaaggaactcttagctttccagtgataataacaataataacaacattctgtacttactttgtgccagaaatgctccaagtactttacatgtgttaataatgctcacagcaatcctaagaggcaggtgctgttattatccccattttacacatgaggaaactgagatacaaaagttaaataattgtcacacagctagtgatagaactgggattcaaacctggggagtccggcttcagagtttgtggtcctgcagagacaaaacagccgcttttccagtattttcccagtatggtcagagaagacctgggtgcttgccaagatcctttgacctttaggaatatttccctacagccttacaaaacatcaattttggctgagcctagtacccaacactatattcagtttgtaagaaattaccattatcacatttcctgtttgtcttggagaggttgtcctatctcgcaccacatggtagggaattgtgaacaacactggacagaaagttaaagccttggattctgtactcttcattcctgtaaaccttgggtaagtttcggaattctctgtgagcttcttaaagtttttgaaagcatgtaaccggataagtgtatttttacaatggaggagttacagtcatcttggtatttgtgggagattggttccaggatccccaagcataccaaaatccaaggatgctcaagtcccttatataaaatggtatagcatttgcatataacctacacacatcctcccatatacttttaatcacctctggattacctataatacctaatataatgtaaatgctatgtaaatagttatactgcattggttttttaatttatattttttgttattttttaaaatatatttttaatccatggttggttaaatctgtagatatagagggccaactgtactgttagacacaagggtctcgaggcttgcagatagagactgaataaccctctccatgatgatcccttagagttcccccactgtgcctttttctttacatgtgcatgcaaacatgtgtctccacatacattttttttaacaaaaattgaattatgttgatatatgtcctgtaatttgtgttttaaacttaatatatcttaggcattttccctgtgtgtgtgtataatgcagctattaaaaatgagtctgaggccagg

SEQ ID NO: 6072 - DNA, 4571 bp, Homo sapiens
gcgctcccggaacgcgcgcaccgcagacggcgcggatcgcagggagccggtccgccgccggaacgggagcctgggtgtgcgtgtggagtccggactcgtgggagacgatcgcgatgaacacggtgctgtcgcgggcgaactcactgttcgccttctcgctgagcgtgatggcggcgctcaccttcggctgcttcatcaccaccgccttcaaagacaggagcgtcccggtgcggctgcacgtctcgcggatcatgctaaaaaatgtagaagatttcactggacctagagaaagaagtgatctgggatttatcacatttgatataactgctgatctagagaatatatttgattggaatgttaagcagttgtttctttatttatcagcagaatattcaacaaaaaataatgctctgaaccaagttgtcctatgggacaagattgttttgagaggtgataatccgaagctgctgctgaaagatatgaaaacaaaatattttttctttgacgatggaaatggtctcaagggaaacaggaatgtcactttgaccctgtcttggaacgtcgtaccaaatgctggaattctacctcttgtgacaggatcaggacacgtatctgtcccatttccagatacatatgaaataacgaagagttattaaattattctgaatttgaaacaacatatttttatacttaatgaattgtatctcattaatctcttcccttacatcttcatgtattgttggtttgttttttggttttgggtttttttttttttttttttggtataagaactaacatcaaaaggcctgtttaaagggaaaggttaatgggctacttaatattatgaacaaaacaaaaaaacaaggctgccacagtggaatattatcttacaagaataagaactacataaaacagatttgtaaaaaatacatatttgaagtattccctgtatttccattattctttatggaatataaagtaagcatgaaaggtagttaaaactttcaggtgcctgtagagtcataataactgtattttatgccttgcattcacgcaaattcacattggatgtgatttaaaagtagacattctctttttcctcttttaggatatgtttgattactggaaaattaatatggttatttgttagaagtctggtttataaaaaagccaaaagtgatggaatttattccatttgtcttaggaaggcccataatacttgtttttcttacatgtgactagcaactttctccacttaaagactaaatacctctttatatgatgtaaattattctaattcattttaaaatcttttaggtcagcaaaatgtgtgtcttcagtgctttctctaaaaacgttcctttatagctttgtacttttttttttagcgttgccattgaaagttaaaatgtttgcatggtttaccctctgagttatgtttcttctagtgagcatgcctgctgtcactaagtgaattatttactactttttgtaggtctatattttaataattattgggataataataattgtggtatgctttccatttacaaaccactcatatactttagtgtatgtcatcctcaataatctaatgaggtaagtagtataagtgttagctctttgcagataagaaactgaaacccagaagtttattgaattgcttcattgttacctagccagcaaggagtggaattaaaacttgaactcagatcttctaattttctgagctcatcctttctcttatacctcagattgcagactaatcaaattttacttaaaaccttcctgatatttttgttaccctggacaccctttctattctagaaaaggtttcccattttatatggaagtgactaattttcaagctgccaacaacttatatcgaggtaatattttattctctgaataaattcatttcacttatattaaaagcataaggaaatctacatgtatgtaaaaataacttagaaattcagtacataatacatgattgaatacatgatcgtatttaacatgttttttttttctgcagtggacaaataaacatcctcaaagtagcaactgcaaatcagttacccttagaaaagcaagaccaaacactgtagttacactattagcagtgaccaaaaagggctaatattttctaagaatagtttaaattacagacatttgttatatttaccttatgtgaaatacatcactatttaattacattaattttaacatctgttgtgtggagttgtatagttcatgcaaaagcctgtgggtatgggtttttcaaaccagcagaaaggtcaaaggtacctgaatgctaaactgcctggctcccagctttttcattaaacttttcagggtcttggtttctttatctgtaaaatgacagagttggaccagttaactttaatggccatccttttacaccacacaagttgataaaatttatctgttcagcaaagagattgaacaaaaaagcacgttagtaatatgaagacaggaaaacgaatgaaagtctaacacataactcatattgatttactttatttctgttagattttacactctgaaaatttcacctcatttagtttgtacaaatactagacatggaaacttaaaatgtgcaggtgtcaaagcttaaaaatcaggtgtgtcctctttaaaggcatgtgcgataagcctgcagtcttaaccagacctggtaccagtttaacagttcatgatacttctgtgatgagtggatctgttagtctggtagagattaatgttgaaatttacttgaattacagttatttgacaagcccactttttttggagtttggtgaggaagataagtaaaaatgcccaactagtacaatgtggagaaagttttctgtttgcttgactaagggaaattgctcagaaaaagaatgctccaacatgggaataaggaccttcagtctcaggaactcatttttgggtgcagtttctacatttaaaaaattgacttgtgttcagtttgataaccagttcatttgctttagtctcagtgttttaaagaagtctcataatgttctacaaagacacaaagcttcaggcttatacaaaactgagtatgattagaaatacctgagcccagaaatgattctgagaaaagagaataatttgaagacacttatttaaaagtaattatggttagaaatgaattaatttaaaaatgtgttcacatatccctttctctaacagtttaacctagacaaacatctgtatcagtatttttttattcccctgattgattacatttggtttctttattctgaaaggaaaataacaaaaacttcagaaattcctaagggtgtaataagaaagtgggttttgagtttcctttcctggaattattttacagttctttggtgggtctcgtcagccaattcatagctgggctttaagattatcatcttagagatgatagatgggctttttaaagatttcatcttagagatgaaaagctgggctttttctctaagatgataatcttaaagcccagctattaattgataatgaacatttttcactatttttttttctatctgaagcttagagatctagagctttggatctttcgggtatatgtcaatggaggtattattttataatactttgcattgacatgaagtgggttcatgggggaaaaccatgagctgtgaacattggtagcaaacaagcatatattcatttcaaaactttccttgcttttagcagagagaagcctgtatatgttacatgtgtgactttcagtagtttaaagagatgtttcaaaaaattgttgcatgtttttgatgcaatttgggaaattgtttacttcacaatgtagtcattcataaaaaaattcatgaaaatactgaacatatgtttgaggatttttcttttcctttttaaatttttttattttttctgagacggagatctgctcttacgcccaggctagagtgaagtggcgcgatcttggcttactgcaacctccaccccccaggttcaagcgattctcctgcctcagcctccggagtagctgggattacaggcgcccgccaccacgtccggctaatttttgtattttcagtagagacggggttttgctatgttggccaggctggtctcaaactcctgacctcaagtgatccacctgcctcggcctcccaaagtgttaggataacaggtgtgagccaccgtgcccggctgaagatttttcttaattgcaataaatattcagcattttttctaatgaaaatgaattttgtttaccagtaaaagtatgcattttaaaagactttcagatttatgctttttacgtgaagctgctaaactaaaagtaaatggaagaaaccaagtctagtaggttttttctttttttttgtgggggtgggatgggggaggttagttacacttaaaatatcttctccagagactgtatgctcctatactagactgtaagctctttgagggcagtctgtcagatttatctttgtatcttccccagcgcctagtgtagtgccttgcacataataggcgcccaataaatattgatgaagaatgaa

SEQ ID NO: 6073 - DNA, 2329 bp, Homo sapiens
gtagcgccgggacgccgggacgcctggataccgggagagcgctgggactctccgagcccggcgcgggggtttccgcatcttacgggcggggccggaagaggaagtcgcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgctcaggaagcaatcttgcatgcgtctggaaatggcacaaccaaggactactgcatgctttataacccttattggacagctcttccaagtaccctagaaaatgcaacttccattagtttgatgaatctgacttccacaccactatgcaacctttctgatattcctcctgttggcataaagagcaaagcagttgtggttccatggggaagctgccattttcttgaaaaagccagaattgcacagaaaggaggtgctgaagcaatgttagttgtcaataacagtgtcctatttcctccctcaggtaacagatctgaatttcctgatgtgaaaatactgattgcatttataagctacaaagactttagagatatgaaccagactctaggagataacattactgtgaaaatgtattctccatcgtggcctaactttgattatactatggtggttatttttgtaattgcggtgttcactgtggcattaggtggatactggagtggactagttgaattggaaaacttgaaagcagtgacaactgaagatagagaaatgaggaaaaagaaggaagaatatttaacttttagtcctcttacagttgtaatatttgtggtcatctgctgtgttatgatggtcttactttatttcttctacaaatggttggtttatgttatgatagcaattttctgcatagcatcagcaatgagtctgtacaactgtcttgctgcactaattcataagataccatatggacaatgcacgattgcatgtcgtggcaaaaacatggaagtgagacttatttttctctctggactgtgcatagcagtagctgttgtttgggctgtgtttcgaaatgaagacaggtgggcttggattttacaggatatcttggggattgctttctgtctgaatttaattaaaacactgaagttgcccaacttcaagtcatgtgtgatacttctaggccttctcctcctctatgatgtattttttgttttcataacaccattcatcacaaagaatggtgagagtatcatggttgaactcgcagctggaccttttggaaataatgaaaagttgccagtagtcatcagagtaccaaaactgatctatttctcagtaatgagtgtgtgcctcatgcctgtttcaatattgggttttggagacattattgtaccaggcctgttgattgcatactgtagaagatttgatgttcagactggttcttcttacatatactatgtttcgtctacagttgcctatgctattggcatgatacttacatttgttgttctggtgctgatgaaaaaggggcaacctgctctcctctatttagtaccttgcacacttattactgcctcagttgttgcctggagacgtaaggaaatgaaaaagttctggaaaggtaacagctatcagatgatggaccatttggattgtgcaacaaatgaagaaaaccctgtgatatctggtgaacagattgtccagcaataatattatgtggaactgctataatgtgtcattgattttctacaaatagacttcgactttttaaattgacttttgaattgacaatctgaaagagtcttcaatgatatgcttgcaaaaatatatttttatgagctggtactgacagttacatcataaataactaaaacgctttgcttttaatgttaaagttgtgccttcacattaaataaaacatatggtctgtgtagtttccgagatgtactatatacagtatatttttctaaaaaaaaatgccttgacccacccctatacttttttttaacgaaatctgtttctttcagctctgatggtagatacaagtagttactatttctgaatgggttttactgtaaagaattatgcaaattggccaggcgcggtggctcacgcctgtaatcccaacactttgggaggccaaggcgggcggatcacgaggtcaggagatcgagaccatcctggctaacacggtgaaaccc

SEQ ID NO: 6074 - DNA, 2183 bp, Homo sapiens
agtaggaactgaagaagatggcgtgcctgggcttcctcctccccgtgggcttcctcctcctcatcagcaccgtggccgggggaaagtacggcgtggcccacgtggtgtcggagaattggagcaaggactactgtatcctgttcagctccgactacatcaccctcccccgggacctgcaccacgccccactcctgcccctgtatgatggcaccaaggcaccctggtgcccgggtgaggattccccccaccaggcccagctccgctcccccagccagcggcccctccgccagaccactgccatggtcatgaggggtaactgcagcttccacacgaaaggctggctggctcagggccaaggtgcccacgggctgctcatcgtgagccgggtcagtgaccaacagtgctcagacaccaccctggcaccccaggatccccgccagcccctggcagacctcaccatccctgtggctatgctccactatgctgacatgctggacatcctcagccacactcgtggggaggccgtcgtccgcgtggccatgtacgcacccccagagcccatcatcgactacaacatgctggtcatcttcatcctggctgtgggcacagtggctgcaggcggctactgggccggcctgaccgaagccaaccggctacagcggcgccgtgcccgaagaggaggggggtctggtggtcaccatcagctgcaggaagctgcagcagctgagggagcccagaaggaagataatgaggacatcccagtggacttcacgccggccatgacaggcgtggtggtcaccctgtcctgctcgctcatgctgctgctctacttcttctatgaccactttgtctatgtcaccattgggatctttggcctgggtgctggcattggcctctacagctgcctgtcacccctggtgtgccgcctgtccctgcggcaataccagaggcctccgcacagcctctgggcctctctgccgctgcctctgctgctgctggcgagcctgtgcgcaaccgtgatcatcttctgggtggcctaccgcaatgaggaccgctgggcgtggctcctgcaggacacactgggcatttcctactgcctgttcgtcctgcaccgtgtgcggctgcccactctcaagaactgctcctccttcctgctggccctgctggcctttgatgtcttctttgtcttcgtcacccccttcttcaccaaaaccggtgagagcatcatggcgcaggttgccttgggccctgcagagtcttcaagccatgagaggctgcccatggtactcaaagtgccccggctaagagtctccgccttgaccctgtgcagccagcccttctccatccttggcttcggtgacattgtggtccccggcttcctggttgcttactgttgccgctttgatgtgcaagtctgctcccgtcagatctacttcgtggcctgcaccgtggcctatgctgtgggcctgctggtcacattcatggccatggtcctcatgcagatgggccaacctgccttgctctacctagtgtccagcaccctgctcaccagcctggctgtggctgcctgccgccaagagctcagcctcttctggactggccagggcagagctaagatgtgtgggctcggctgtgccccttcagctggctctaggcagaagcaggagggcgcagcagatgcccacacagccagcacacttgagagaggcaccagccgaggagcaggggacttagacagcaaccctggagaagacaccactgagattgtcaccatatctgagaatgaagccaccaatccagaggaccgcagtgatagctccgagggctggagtgacgcccacttggatcctaatgagctgcccttcatcccccctggggcctcggaggagctgatgccactgatgccaatggccatgctgatcccactcatgcccctgatgcccccgccctcagagctgggccatgtccatgcccaggcccaggcccacgagactggcctgccctgggcgggactccacaagaggaagggtttgaaagtaagaaagagcatgtcgacccaggctcccttgtgaactggaggcactgggacacacgcctctcaaagggctggtggaacattgcagagcaaagccatgcatggcaacaagaaatcagggtatcaaagagatttcatatctacccaa

SEQ ID NO: 6075 - DNA, 4148 bp, Homo sapiens
gcccccgcccctcctcccctcggcgggtgtgatcgagtggcctcgcctcatcgcctagcgcccccctcagtcgccgccgcctccgcccgccggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctgcagcggagccgccgccgccgccgcgggtgagggaggccgagagcggagcccgccccgccccggggcccagggagcggggccgcttcggagcccggcctctccccgccagccgccttcccggcccgccgtgcagccagcgagccagcgagcgagcaagcaagcaagcaccggaccccggccgcgccttcagctacggcccgagcgagcccgccgccgccgggcccggccacagcctgcagcggagcccacgagaggcagcgccatggcggagcagacctactcgtgggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcaccaataatagcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctataggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagcccttacttggttttgatcagtgtagcaaattagggatgaagagttcaaaccttttggccctttctttcttttctaggcttctccctcgcagggtgttccgtagtttcttctcgagccaatgcatgtattatagcagcaggtgtctttgtgctttctcatcatagtaacgtactacttgtaaatacatttttctattttctatttttttgtatttttttttttgacattttgtttcattggtgtgctgtatattttccatgccctcactcctttaagaaaaaaaaaaaggaaaaaagcaacacaatcctgtccttgctgttgtgattatagtcttggtttacctgtggtgacaaccgggtgttggggacacatgtcaaatgcccctctgagatgggccctaaattccagtaactggggaaagaaccagctgctgtgtcctgagagcctggccctgtgctgtggtctctgctgcaagcccagatttctgggagtaactagtgttaggtctgctgacctttacctaagcagcccctgcctggtaagaaggtgcccattgttcagaggcaaagagaagcctgcggttggcatgaggatgcctgacaacaaaggctggagaagggccctgagttccagcctctccccaagggtccccgccccagtggctgcctctgtcttgacctgtgtaatgaattagtgtgctgtgtcactgtggcttgaagtcactgtggatcgagctcacagggggcacccatcctgttgtcaacagagtctgaagcagtcagggtgttggattcctctgttgttgtcatcaattcctgctgaggggtttctggggttttgtttttaataaatgactcctttgtagcctttgtcacataatcttcactttggttgttggtaccaaacagagctcccagccatctcctccctgttctggaagactgatgggaagactctgtctgtccccagacctggtcatctgcagctctggcccagtcatagatacatcaaagaactgaagcttctgctgtccacagaactcaaaactgcctctgcattgggtgaagactaaaaatccacttgcggactctcccttccttccttctcagccctcgaggatgcatatagctaattaagcaggcccagagacagagaggggggctccaaaatgactcggattaagggcaagtgccagtgatgggtagaaataacgttatccttcatgcctgtaatcccagcactttgggaggccgaggcaggtggatcacaaggttgggagctcgagaccagcctggccaacatggtgaaaccccgtctctactaaaaacacaaaaattagctgggcatggtggcaggcgcctgtaatcccagctatttgggaggctgaggcagaagaatcgcttgaacctggaaggcggaggttgcagtgagcagagattgcgccactgcactcaagtctgggcgacagggtgagactccatctcaaaaaaaaaaaaaaaaaggaaatgttatcctggcagtgggtcattttaatttttctgtctttgttttcataagaaaattaaattccagacagaaggaacgtc

SEQ ID NO: 6076 - DNA, 1878 bp, Homo sapiens
tccattaggactcactgcatggcctattccctggtggattccagtcaagtgtctacatttctgatttccattcttcttatagtctatggtagtttcaggtcccttaatatggactttgaaaatcaagataaggagaaagacagtaatagttcttctgggtctttcaatggcaacagcccaataataggcatccaaacaattgactctacccaggctctgttccttccaattggagcatctgtctctcttttagtaatgttcttcttctttgactcagttcaagtagtttttacaatatgtacagcagttcttgcaacgatagcttttgcttttcttctcctcccgatgtgccagtatttaacaagaccctgctcacctcagaacaagatttcctttggttgctgtggacgtttcactgctgctgagttgctgtcattctctctgtctgtcatgctcgtcctcatctgggttctcactggccattggcttctcatggatgcactggccatgggcctctgtgtcgccatgatcgcctttgtccgcctgccgagcctcaaggtctcctgcctgcttctctcagggcttctcatctatgatgtcttttgggtatttttctcagcctacatcttcaatagcaacgtcatggtgaaggtggccactcagccggctgacaatccccttgacgttctatcccggaagctccacctggggcccaatgttgggcgtgatgttcctcgcctgtctctgcctggaaaactggtcttcccaagctccactggcagccacttctccatgttgggcatcggagacatcgttatgcctggtctcctactatgctttgtccttcgctatgacaactacaaaaagcaagccagtggggactcctgtggggcccctggacctgccaacatctccgggcgcatgcagaaggtctcctactttcactgcaccctcatcggatactttgtaggcctgctcactgctactgtggcgtctcgcattcaccgggccgcccagcccgcccttctctatttggtgccatttactttattgccactcctcacgatggcctatttaaagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctataggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgct

SEQ ID NO: 6077 - DNA, 2016 bp, Homo sapiens
gtaggccatggagccgagcagatccgggtcttcgggtggccgcaatgtcccaagtggacgacacccacctagtcccgaggacaaccgacaaagtccttaatgggcccagaaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactcagacgtccattactgacagctgtgctgtatacagagtcaacaataacaggggcaatagtctgaccttgattgaccttcccggccatgagagtttgaggcttcagttcttagagcggtttaagtcttcagccagggctattgtgtttgttgtggatagtgcagcattccagcgagaggtgaaagatgtggctgagtttctgtatcaagtcctcattgacagtatgggtctgaagaatacaccatcattcttaatagcctgcaataagcaagatattgcaatggcaaaatcagcaaagttaattcaacagcagctggagaaagaactcaacaccttacgagttacccgttctgctgcccccagcacactggacagttccagcactgcccctgctcagctggggaagaaaggcaaagagtttgaattctcacagttgcccctcaaagtggagttcctggagtgcagtgccaagggtggaagaggggacgtgggctctgctgacatccaggacttggagaaatggctggctaaaattgcctgagaggcagctctaaagcacaagacctggatgtgtgacacacagttttggaaaaaggtctgtggtagtctggagttgatgaggaaggggtacaagatgtggttagaaacatttctttgttctggaaacaaagtactgttgaaaccagcttggaattttttttttttttttttttaagttcagttctcccttatggctgcctttcaaacaagtaccttttatctgatgcctgtatcttccctttgttaaggtgtaacttgatgtagggtcaaggtttttgtgacaacaggcagactccacacagagaggatatgatgagaatatggccatcacctgaaaagttttcttatcttctgtgcttttggtccctggaaacaaatccgcctatgtatgaagctagttgatttccagttgcactatttccagttgcctctgaagttcacaggcaatacattgtctagtcctttgcgaatttctctgatttgtgggcacagttatgaagtttccccacatgtgaagacaggtacaaaatagcagagccaagcagacagtgggtctattcttcattagctcagtgacttgtccacactcgtcttagcacttacgtttcaaaagcttgtcacaaacccttggagtcattcccagataatagaactggaaatgataaatcccctaatgccaagggtctagtgtgttcttagtggttatactgggaagtgtgtggagatttaggtgctgctctgctgctctggatggctgaaggctcctgggccatcttcatgtgctgcttgaagagctcctattttgtactcctggctagaatgctgtggaacaaatacaaagtgaaaaaagttctctgtagatttctgaagtgcatattcattgatgccaagaaaaaaaaaaagttgcctttttgaa

SEQ ID NO: 6078 - DNA, 512 bp, Homo sapiens
atctcttaaaagatgtgtgtgtccctcgacaaataacctgtctgcccctatcgttctgtaggaggacggagtcccagagaactacaactcccatcaagcacttgggggatcgccgcggctgagggagagactatggcttaggaaccaccattcgcgtgaggctctgctccccgcgcctgcgcagagtgcagggccacgtcgcttttgctgtaccggggaccacgcgtctcatccatggcttccgcggactcgcgccgggtggcagatggcggcggtgccgggggcaccttccagccctacctagacaccttgcggcaggagctgcagcagacggacccaacgctgttgtcagtagtggtggcggttcttgcggtgctgctgacgctagtcttctggaagttaatccggagcagaaggagcagtcagagagctgttcttcttgttggcctttgtgattccgggaaaacgttgctctttgtcaggttgttaacaggcctttatagagacactca

SEQ ID NO: 6079 - DNA, 9669 bp, Homo sapiens
cggagcccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtagaagataaagaggaagaagatgtgtctggtgaacctgaagcttcaccgagtgcagatacaactatactgtttgtaaaaggagaagattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcgctttggttgtatagcttcctcatttacttcatggtcttacatagctggtgactttcagggctaatctgccctctaaagcattgtcccaggagaggaaaaggaaatgggacctcagaagtagaagcctcagggaaggagtaaagtagaaatcagaagaaaagaagcttcacttgatagtaataaggtttttaacttcaagtaccttcagaaaatgtgattttgataagaggaaagggcaaatttagaccttaaaaaatatggaagaactactgccttaaaagtgcatttgtggcacatcagcctagaactgtatcatggctgtgctggggagaagtaaatggtggtaatgtaacattgccacctttacttaatgatgtgttattttcgaggtacagtagatcaatatagtaataggcgagcctcatatatagcattcatcttgtacaatgatatccatacccttgatatgaaggaaaattgacttggtttgtgcatttgaatactgaaataattttttaaaactcagtgacacataccatctcttgccaagactagaccctgtattttagttcctaaattagatgtttaaatttaaaaacattttcagatgtacttaagtacttccatagtacttttttttttttttttttttttgccccctgagacggagtctctgtgtcacccaggctggagtgcagtggtgcgatctcggctcactgcaacttctgcctcttgggttcaagcagttctccctgtctcagcctcctgagtagcttggattacaggcgcccgtcaccgcacctgcctaatttttgcatttttagtagagacggggtttcgtcatttggccaggctggtcttgaactcctgaccacaggtgatacgcctgccttggcctcccaaagtgtgctgggattacaggcgtgagccactgtgcccggcccactgttcactttttgaatggcatcattttatagctgtagaactaaaatcaatgtttgccccaattttcttaagtaaaactctactttgagctcttacctccaacttagtaaaaagcagcttcacacacaaacaagattcttactggtggaatgttaggtttcgttgttaagttaatctgtctataagctcatccttagaggatatttgaggaggaagaacaccttgcagctgacttgcaaacatctaaataatttatttcgggtgcttatgaatgttactaatggattttgtatgaatttttatcccttttcatttatacaaaaacctgggcttttatgttaattatatcatctgaggttctaaggttttttttttagattttgaaatttagggataatagctcttaggtttgggtaccactttgctgcagtttaagaaagggggaagggaactcatttattaaacatcaatcacgtgctgtgttctgtttgttttctagtcatcatatcacacacctttacgacagctcactgaaggaaggtgatactgttcccattttgtagatggaatagacaaaacctgaatttaagtagcttgctcaaggttccatattgaatatggaaagttcaaatcatctcagtaatgaatataccatatatacttgctgtattgtatctatgataattcagttacccacaatacccttttaaatttctgttaatgacatacctttaaatgtctccttgatgaacagaatcatggtctttaaaaacattttcatgggttgattgcattttcaagctctaaaggattgaaagataaatcttcacgttaaaggtaagagtgaagtatctgctcttgggttacagaaccagatagtactagaactaagattacagggtaaagctgcttttatcttttttctttttctttttctttttttttttgacatggggtctcactgtattgcccaggctggaatgcagtggcatgatctcagctcacggcagcctctgcctcttgggctcaagcgattctcctgcttcagctttccaagtatttgggaccacaggcgcacaccacaggcctggctaatgtttttgttttgtttttggtagagacggggtttcaccatgttgccaggctggtctcgaactcctgagctcaagtgattcacccaccttggcctcacaaagtgtcaggcttacaggcgtgagccactgcgcccggctcacagggtaaggcttctgtctggtgtgttgtattacggattttgcttaataggcacagtgaggcattaaaaagaaaattcagtatgcctgtagaaaggataatccttgtttaaagtctccaaattgcagtcaaagatgttttgactgtgcctttttttgttcccctgctgtcccttatgtagacttctgtcagtacccatggcagcctgtcatcttgttgacatctccttctggactgtgagctctgtatctggcttgtttttcatccccagcttctagttcacaattaggtagaaccctattactctttgaagaaggaacaagaaaatgtgggccagttttcatttgccattcttccatgtgagttagtatggttcgtaagtattcctggtgatacgctagtattggcaattctgtgaggttgaacaaaggggtggtatggtgtgctagcgtgggaattaggagacctctgggtcttgacagtgccctggccactaagcaaaggcagttcatccttggagtctcaatgtgcttttttgttaattgagatatgcttgaagtatcagccctaaatagtctgattctgtgacctacaaacccttacttaattcagtgttactataaatgattcttcccttaaacctactttttacttagcaaaagagaaaaaaaaaaaaaggaaacgctcatgtcaggctgcctgggtttgaaccccagatcccctcttagttggaggcaagttgtatgatgcttcagcttttggttcctgcctcctaaggttgttaggagttactgtgtgtagctgcttagaacattgcctgggtctcagtaagccgcttaagtgactgctctcattttcgctgtaaagcaccatactgtaataacatcccatgaagcatggggcggggaagagtatatggtaccttatggactttgatgtggtggggtagtaggtaaattctgaatatgtaagctacatagtattctttttgtaactaaaggataaaagttttaagatgggcatgtaatatggctagcactggattttaatgatgagccagagtaataaggctggcaaggggagtttttgttttgtaataaatctcttacacctgcacatccagttctttttaaaaacacgtttgaagaggctccatatttctcagtgaagctgttggggttcatgttatttttgaaaatcatcttgcaatttatttcagcatcagactgaaccacccaaagaaaattagtctatttctgaacagttttttcagaaaccatattggtctgatcacccaacatttatagaaataggcgcttaaggcctagaggcatttcagaaaggagaatgagaaatactgtggtcaagagtagtgttcagatggagaacatcaagcatctgctctgcccttccacacacatcctcatttcatcttcacaactgccctaggtaaccttgttatctgtaatgaaacagcctcaaggagcacagaggcactcactcctcacgtttggtctgttgccatttccggcttggttggaatagggtaggagccttttggcagggagcacattctcagtaatgcagagtgcactcacctgggttctagcttcaacacttaggatttgcttgatattttgtattctctgaggcactgcctgtatttgtttctgctatcacagtccagagtcaagcttcatttataaagactgggcagggcatggtggctcactcctgtaattccagcactttgggaggctgaggtgggtggatcactttaggtcaggagttcaagaccagcctggccaacatggtgaaaccccatctctactaaaaaatacaaaaaggccgggcacggtggctcacacctgtaatcccaacactttgggaggccaaggtgggcagaacacctgaggtcaggagttcaagaccatcctggcgaacatagtgaaacctcgcctctactaaaaatacaaaaattagccaggtgtggtggtgcatgcctgtaatcccagctacttgggaggctgaggcaggagaattgcttaaacctgggaggtggagattgtggtgagctgagatcgtgccactgcactccagcctgggagatagaacgagactccatctcaaaaaagaacaaaaacaattagccgagcgaggtggtgcacgcctgtaatcccagctactcatgaggctgaggcaggagaatcacttgaacccaggaggaggaggttgtagtgagtcaaggttgcaccactgcactccagcctgggtgacagagtgagactgtctcaaaaaataagtacataaataataagtaaaagctactaacaattaaaaaataaataaataaagacaagactgtctggaaaatggctctcctaaaaggaccagttgccatcatccacagtggaagattcaaagcagttggtccttggtacgtatgagaagcggatttcattcccttgaattctacagagcagtttattagagtgaatgcattttaaggccttgcatttgatatgtcatccagttcataatcaagttgcctttttctggctaaaacataatgattatgtatttttctcatttggtcctacaagctgctggccctttgtccctccactgtgggaatcagatctagaggaggctgagcctgcagacacagcagtggccaaaaggtcactctaagtgttttgtcttgactccttacttgaagtccacccagctagcacacatctggtttatactgaagccccctgcctagaaatactcatttcaggaaccaccagtaagcatctgtgaccacacaggctttttgactgatggcttcccggatctggtttcaagggataaccccgtctgtgtgcatctatggtcttctctctacagcgaggactttgcagtgctgcttgtggtccacacaaggggctcagagctgagtctgaactgcttcatggtcaccagctcctgtcccttccagtcttgagaggcttttttctccagatggaacctttccttcccgccgttttctcggtctctggctgtttttctcttgtgcccgtctaattggacacctcctggcttccatctctgtggttctcctgcctcacttcctgttctgttgtttttccgttttgtcaaaatatctcctatgttcttggcttccttttcgtcgccaggttttcagctttcctttagctcttcttctaatatggcttctgcccacaaaagcctgctctgtcaggatctcatggttctccacttgccagaaccttcttcagcctcagttcctcggcctcaacttgtacgtttaacccattgaccaccaccccccaaattcaccttcatttctttgaccctgctcctcactccttttctgttgaggaatctgttgactaactccaggctcactcaggctcaccgtcctgctctctgcaccagcctttccagagcgtgccagttctcatggcttcatctgttaactgttgatcacttcagtcctgatttttagacctaaatggtttccttaacgccattctaactgcctgtgactcattttcacttacagtgtttattgtaacgccaaaccaacaaatcacaggtgcttgcttctctccataaatctccccagtctaactttttgtcattcaacatgactcgtttatccaacctgaaatcgcatatagccccaagtatggtgttttgtacacaggtatttaataagtgacttccagttttggctctgctatgaataaaaagagatttcagttctcttcactttgaaatctaacaactcagagaacattgaagaaattggaatttagttgggatgaaatacttgtggtttaaaatatttctgttcatattttctaatttgttgccggaggtcttgggttttctatttgagtgcttgcaaactcaatgtgatttctgtcagcatatcttaggtttgtttgttatgaaacttatgcagtgtgaggttctatctgaaaatgttatttagctatcttctgggactatttaatgaaagtggggtcatgaatccttaaaattcttgtgcagctttgagaaacatttctgttatttgggtatcagtttgtaagtgtggtaaagccaagatggaaacgagcactttgctttcttggttgttgttactggtctaacctcctgcttgaactagtctgctgtcctgtcaaatgcatctttttatttacatgtcccttaaattaaagctgatcatgaaagta

SEQ ID NO: 6080 - DNA, 3155 bp, Homo sapiens
cccggatgaagagtaacgccattaccgccggagccgccgagagccttagccgacggaaactggacactggaccggcagcgccatgagactcctcccccgcttgctgctgcttctcttactcgtgttccctgccactgtcttgttccgaggcggccccagaggcttgttagcagtggcacaagatcttacagaggatgaagaaacagtagaagattccataattgaggatgaagatgatgaagccgaggtagaagaagatgaacccacagatttggtaaaatattttccagcaaataacattgtgaagttcctggtaggctttaccaacaagggtacagaagattttattgttgaatccttagatgcctcattccgttatcctcaggactaccagttttatatccagaatttcacagctcttcctctgaacactgtagtgccaccccagagacaggcaacttttgagtactctttcattcctgcagagcccatgggcggacgaccatttggtttggtcatcaatctgaactacaaagatttgaacggcaatgtattccaagatgcagtcttcaatcaaacagttacagttattgaaagagaggatgggttagatggagaaacaatctttatgtatatgttccttgctggtcttgggcttctggttattgttggccttcatcaactcctagaatctagaaagcgtaagagacccatacagaaagtagaaatgggtacatcaagtcagaatgatgttgacatgagttggattcctcaggaaacattgaatcaaatcaataaagcttcaccaagaaggttgcccaggaaacgggcacagaagagatcagtgggatctgatgagtaaatgttcctttgtgcaacaattcggtctttacttaacctgccctaatatttttcggcctgatgggaattagtgcagagaagccatgtcaccatagaaggcaactcctacttgtgtgtggactgagcaatcagagtctgtggcgataatattgctgaaaatgcactgcattcatttttctaaagtaacaaatttggtttttttttaaaccattaaaatctatgtgtgtgcgtgtgtatgtatgtgagcagttggtcttaccagaatcattgttgaactacctgaaacaagtctttagaatactaaatataatgctgttgtctcttcctttttgacattttctgattttttcccccaaaactcagttaatatttacccactatgattattgatgtcctgccttgaacagttttaaagaaaacaatttttggaatagctcaaatttcaattgatggcacaaatcagcattttgttgttgttactgtattacaattagtattctaaaggcagaagcagaagtagctgctttttagcaatagaattgtttcagtattttgctgctgtttaatgcgcatcttcagaaaacttcccagtggcttcaaggaatttggggatctctctggcaacaaattgtgaaacatgaaatttctgctgactttaatatatgaaacctaatcctacccccttttttaacaaaaagaaactagtacatttgtgaaaattgtgttgtgttgtccattgttgctctagttctgacccagaggtagctctggagtgattttagacctactcactcagttgtgtgtaggtttttttgttttgttttgagagagaatttttctctccttaatagaagcatcctttttaaagagaagttgccttggtccacacactaagcagaaaaccaagttatcaggacagagatatttcccagttactcctaatcaatgaagaaagtgagttggatatttttaaagcagttaactaattttttcttacctaatcttttgggagttttgcttgttgatataacctttttagttaacctgaaagattccaaaaattgttcttaagtgcttgagactggaaccaaaattaaattgtacttcataaaatcctcttatagagttactcttgccctagattgtaaattaagtttggcattattgtcagactggatggagggtgaagtaaaatagtatgaacaattaagaggctctccccctcttgtctttaagccatattctcctacatgtattttataagaaaatgttaagtcaaattttagtggctctttaattcctgacctcttcattctccttttcagtataacctcccctatgctcatgcccacacagacaaaaaaacaaaacgaaatacacacagaaaaaagtctttccaaactgtttaagtatttaaacatctgagccaaagcagatagaagttattgtataattgttaatcactttgcaaataggggctatcaaattacctatattggcattgctggattataaactctatatctgtaatataaagtgtttgagtttttaattgggctgttatgatcagtagttgattttgagaaagctctatgagctctaagtaactgcatggttttttgtttaatgtaatataggagacccttcacattcccaaggaatatattccaaaacatttttgtgaatatctaagtttgtgaaactactagggcatgatacagtaaggtgtaattacagaatttacgaaatgtaaatggcctctacagagttttatggaatacctggtactaacgtaggcagctgcaaaaccacactgagttacagctgtcagccctcctcattcctaaataacttgccttacatatcagccctcccacttctgaagttcaaattagtgcctcggaaatgtagaatttattatttgtcatttttttttttttagcatagattgagaacagttgaactcttaaatcctcagatgccaggggtctgctctagcatcagtaagtatttagcagaaactaactccgtaatgaatggaattcaattccacacatggtttgttcaagcacacttaataagtagcctattttttaaatgtctttttaaaatgtaaatatttggatgaagtttttctttgttttgatatattcatttgctacaccaactatgttttcagaattcatcttttgaacaacttggtttcagaatatgtaaaatgactttaaggatcttgtgtatcaaacctatccccggatgtgtgagaataatgtgttcataaagcatggatctcg

SEQ ID NO: 6081 - DNA, 3716 bp, Homo sapiens
gttagcggatacggcggccgcaggggcggagtcaagggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaagaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcacaatattacaacttcttttgaaccgtaaatatcagaatgaatcctcttcccaggggattgaacagaagcttaatgtttacaagtgtttgaatttgtgatctgaaataacacaaaattaaaaacatgatttctctaattttccaactagaggaagagaaacttgtggaaaagttctttttttttcttttttttttcttaaagaagggcagccaaggtagtaacctaaaaatagtgcccaggcatatgagagttgtcctacgaggttaaagaacacactgttccactgtatggctttggccctgagtggccagggaggtcaacttgaccctgccatgttggtttgacttactaagacacaggaatcactgttttccttgaccagggtctcacaccctggaggaatgttaagtaagagaaagaacctctttcctgaatattgacatgtaaaagaccaaagtaatttttctgaacttctgcaattctgagaactctccaaggaatttacagtgattttagtgcttgtcagcatttttccatgaggactttcatacatttgactctttagttcacaggttcccattgattgtgagcaagatatttatctctttagcccttggggatccagctgagagcaatctcttgcatttttttacccgtgtatgtacagatatcatttcttgtgtatgccatgacttgaaaaagtttgggaagctctttagcaatatcagctaaaaggatatgaaatcacaggtgatagcagttgtcattcagtaatttcctacaagcagcaccccaaaggaaatatagtcctaatctttactatccacttctaaatttaatgtgaatttcatacatgttattagttgttttctttataattttataaaaattattcatcgggagtttaacttccacttccatgctatcggatgtgttgggctccatgcaagaacttggaagaaaaacaggcaggaatgcatttgcataatgacccagatcatcattttctgcaactgagaattatatttcatcattgcttctagaagtctgcaattctttacttttctttggtgcattattatctaggtgccatcactggataatgtggagtgactagagaagtcacatatcactgtaaggtacagttagggtaacactttagaggtttattatttttaaaaaacttttcttgaactcctggccaacatggtgaaaccccgtctctactaaaaataccaaaattagccaggcgtgatggtgggcgcctgtaatctcagctacttgggaggctgaagcaggagaactgcctgaacccaggaggcagaggttgcggtgagtcgagatcgtgctactactgcctgggtggcaagggtgagactccatctcaaaaaagaaacaaaaaaacccaaaaagttttctttactgttggttaaaaaaaaaagccagaccatagtttgactggtggcatggaatttgtgtatcaaataaatgcatttgcttatttgacaaaccatcagtgtccactatttgttaccagagttgggccactatcttttaaaattgctggtgaaaacttgccactagatggcagtgcctgtatagatggggaaaaaattgccaccattcttggtataatacagtgtagcttagatgaggtggtgaaataggggtatcagccgaatattcctaatatagtttctcttgaattaataaactgaagatttgtaggaaaatgagtgagcaaaatttgtttactgttgtgaatttttcctacagcactgtttttaatcttgatgttttccaactttctgtactaatagatacatttctgtgcataagattataaagcatatactcacagttcagtagttttcgttaaggatttactgtgtgagtactttactgtgaggaattgcagaaccttttcccctctactcttgtctaaaagttctgtgtggcacacagagatgcgacctactcaatctgacttagtaaaaccatgctgtagaatttttgtcttaaaaagaccacatacccagcacccatgaaataaaagattcatctgtaattgggattcaaagtgattaaattcctttgttcatactcataaatagcactaaagtgttataacattttcatttacctatttttagttccttcattttaacttaataaaaatcttggattgatattcttttttttttttttttttttttgagacagcgtctcgctctgtcacccaggctggagtacagtggctctatcttggctcactgcgagctccgcctcccaggttcacgccattctcctgcctcagcctgccgagtagctgggactacaggcgcccgccaccacacccggctaatttttttgtatttttagtagagacggggtttcaccctgttagccaggatggtctcgatctcctgacctcgtgatccacctgcctcggcctcccaaagtgctggaattacaggcgtgagccaccgcgcccggcctagattgatattcttaagcaataaaagtttactggttgtcctatttgccatattattgaaacttggaaaggataatttgaaacaaggtttgaagttaactgaaatatggagattgaatttatactcaattcttgtgaaaagtcttgcttaataagtatgattaaactttgcttcttaaaatttg

SEQ ID NO: 6082 - DNA, 1039 bp, Homo sapiens
gggcctttgcccgccttggcggccggctctacgttccctgttctcgcctgcagctccgccatggctcctaaaggcagctccaaacagcagtctgaggaggacctgctcctgcaggatttcagccgcaatctctcggccaagtcctccgcgctcttcttcggaaacgcgttcatcgtgtctgccatccccatctggttatactggcgaatatggcatatggatcttattcagtctgctgttttgtatagtgtgatgaccctagtaagcacatatttggtagcctttgcatacaagaatgtgaaatttgttctcaagcacaaagtagcacagaagagggaggatgctgtttccaaagaagtgactcgaaaactttctgaagctgataatagaaagatgtctcggaaggagaaagatgaaaggtttgactcctgtttaaagtatggccatcataaaaggggaatcttgtggaagaagaatgaagttgctgattatgaagctacaacattttccatcttctataacaacactctgttcctggtcgtggtcattgttgcttccttcttcatattgaagaacttcaaccccacagtgaactacatattgtccataagtgcttcatcaggactcatcgccctcctgtctactggctccaaatagaccatgtcagcttcaccccctggctttgtgtctatgggtggcctgtggtatatggaaaagtagcagggtggtcagggtgggagacacaagatgtttttatagtctagagcctttaaaaaacccagcagaatgtaattcagtatttgtttattggctgttttttgacagattgttgaaattaaatgaattgaaagggaaactcagagtactaggacgtttattaaaaggaaaaaaatgtcttgcaatgtgctgtaatcacaagaggagaaaataacttgtttccttgatctgtcagaggtcacagtaacctgggccgagctgttattatttattatataatagtagtaggaagttaataactggttctctgtgttccaagcac

SEQ ID NO: 6083 - DNA, 5944 bp, Homo sapiens
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaa

SEQ ID NO: 6084 - DNA, 4129 bp, Homo sapiens
attgtaaactttactggacacaactgatggaagctaaaatcagtgaatgactgtttcaggagaaatgggaggagaagcaggatttgcatgatctccagaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtag

SEQ ID NO: 6085 - DNA, 7831 bp, Homo sapiens
ggtgtggacgttgtctaaatttcggtagccatggcacaagaatataagaaagcatgggattatggcaaccacagaatctcagtagtacaagttccattcagttttttctgaaagaaagccctctgttaaagtgaagcaaagaaactgttgtggattataacgtttagaagttccaatttttcagtgctttacaaataaagcatcatttaaccttttaaatgaaaaagattaagatctcatgcaactgttgtattttctggaagccattctccaaaagggaagtgcacatttaaaacacagatatgatggtccttgctgcagggatttaagtctacttgcttttacatcatgaccagcttgaaacggtcacagacagaaaggcctcttgccactgacagggcctctgttgttggcacagacggcacccccaaagtccacactgatgatttctacatgcggcgcttccggtcccaaaatggcagcttaggatcatcagttatggctcctgtaggacccccccgaagtgaaggttctcaccatataacctcaacccccggagtcccaaaaatgggggtaagggcaaggattgcagattggcccccaagaaaggaaaacataaaagaatctagccgttcaagccaggaaatagaaacctcaagttgccttgatagcctgtcctccaaaagcagtcctgtgagtcagggaagttctgttagcctcaattccaatgactcagccatgctgaaaagcatacagaacacgctgaaaaacaagacaagaccgtcggagaacatggactccagatttctcatgcctgaagcctaccccagctcccccagaaaagctcttcgcagaatacgccagcgaagcaacagtgatatcaccataagtgaacttgatgtggatagctttgatgaatgtatctcacctacatacaagactggaccatcactgcacagggaatatggtagcacatcttcaattgataaacagggaacatctggagaaagcttttttgatttgttaaagggctacaaagatgacaaatctgatcgaggtccaactccaaccaagctcagtgactttctcattactggtggtggcaagggttctggtttctctttggatgtaatagacgggcctatctcacagagagagaacctcaggctttttaaggaaagggaaaaaccactcaagcgacgttcaaaatctgaaactggagactcatctatttttcgtaaattgcgcaatgccaaaggtgaagaacttgggaagtcatcagatcttgaagataaccgatcagaagactctgtcaggccctggacatgtccaaagtgctttgcccactatgatgtccagagtatattatttgatttgaatgaggcaattatgaacaggcacaatgttattaagaggagaaacaccaccactggagcttccgcagctgccgtggcatccttggtctctggacctctgtctcattcagccagttttagctccccaatgggcagcacagaggacctgaattccaaaggaagcctcagcatggaccagggagatgataaaagcaatgagcttgtaatgagctgtccatattttcggaatgagataggtggagaaggggagaggaaaatcagcctttcaaaatcaaattctggctcctttagtggatgtgaaagtgcctcctttgagtctacccttagttcccattgcacaaatgcaggagtggcagtacttgaagtgcccaaggagaacttggtgttgcacctagatagagtgaaaagatacatcgtggaacacgtagatctgggtgcatactattatagaaaatttttctaccagaaggaacactggaactattttggggctgatgagaatcttggtccagtggctgtgagcattcgaagggaaaaaccagatgaaatgaaagaaaatggatctccgtacaactaccgaataatttttagaactagtgagctcatgacactgagaggttcggtcctggaggacgccattccgtcgacagccaagcactcgacagccagaggcctgcctctcaaagaagtgctggagcacgtggttcctgagctcaatgtccagtgcctgcggttggccttcaacacacccaaggtcacagagcagctcatgaaactggatgaacaagggctgaactaccagcagaaagtaggcatcatgtactgcaaagctggacagagcactgaagaagagatgtacaacaatgagtcagctggcccagcctttgaagaatttcttcaactattgggagagcgagttcggctcaaaggatttgagaagtatcgagcacagcttgataccaaaactgactccactggaacccattctctgtacacaacatacaaagattatgaaattatgttccatgtttctaccatgctgccatacacacccaacaacaaacaacagctcctgaggaagcggcacattggaaatgatatcgtaacaattgttttccaagagcctggagcacagccattcagcccaaaaaacatccgatcccacttccagcacgttttcgtcatcgtcagggtgcacaatccgtgctctgacagtgtctgttatagtgtggctgttaccaggtccagagatgtgccttcctttgggcctcccattcctaaaggggtcactttccctaagtcaaatgtgttcagggacttccttttggcgaaagtgattaatgcagaaaatgctgctcataaatcggagaagtttcgggccatggcaactcggacccgccaggaatacctgaaagatctggcagaaaagaatgtcaccaacacccctatcgacccttctggcaagtttccgttcatctctctggcttccaagaagaaggaaaagtctaagccatatccaggagccgagctcagcagcatgggggccattgtatgggcagtccgggctgaagactacaacaaggccatggaactagactgccttttagggatctccaatgagttcattgtgctcattgaacaggaaacaaagagcgtggtcttcaattgttcctgtagagatgtgatagggtggacttcaactgacaccagcctcaaaatcttctatgaacgaggagaatgtgtttcagtgggtagttttattaacattgaggagatcaaagagattgtcaaaaggttgcagtttgtttcaaaaggctgtgaatcggtggagatgactctgcgaagaaatgggctaggacagcttggcttccatgtcaactatgagggcattgtggcggatgtggagccctacggttatgcctggcaggcagggctgaggcagggcagtcgcctggtggagatctgcaaggtggcggtagccactctgagccatgagcagatgatcgacctcctgagaacatctgtcacggtgaaggttgtcatcattcccccgcatgatgactgcaccccgcggaggagttgctctgaaacctaccgcatgccagtgatggagtacaaaatgaatgaaggtgtttcatacgaattcaagtttcccttccgaaataataacaagtggcagaggaacgccagcaaggggcctcattcacctcaagtcccgtcccaggtgcagagtcccatgacctcgcggctgaatgctggaaaaggagatgggaagatgcctcctccagaaagagccgccaacatccctcgaagcatctccagtgacgggcgcccactagagaggcggctgtctcctggttcggacatctatgtgacggtctcatccatggctttagcaagatcccagtgtcggaactctcctagcaacttgtcttcatccagtgatactggttctgtggggggcacttacaggcagaagtccatgcccgaagggtttggagtgagccgtagatccccagcctccattgacaggcagaacacccagtcagatattggtggcagcggaaaatccacgcctagctggcaaagaagtgaggatagcattgctgaccagatggcttacagttatagaggacctcaggatttcaattcttttgtcctcgagcagcatgaatatacagagccaacatgccatctcccagcagtatcaaaggtactgccagctttccgagagagccccagtgggagattaatgcggcaggatccagtggttcatttgtctccaaacaaacaagggcattctgatagccactactcgagccactccagtagcaatactctctccagcaatgcgtcaagtgcccatagtgatgagaagtggtacgatggggaccgcacagaatccgaactcaacagctataactatctgcaaggcacctctgctgacagtggcattgacaccacctcttatggccccagccacggcagcacagcctcgctgggggctgccacatcgtcacctcgctcagggccaggcaaggagaaagtggcacccctatggcacagctccagtgaagtaatctccatggcagatcggactttggagacagagagccacggcctggaccggaaaacagagtcttccctgagcttagacatacacagcaagagccaagccggctcgacccctctgacaagggagaacagcaccttcagtataaacgatgctgcttcccacacaagtaccatgagctcccgacactctgccagcccagtggttttcaccagtgcccggagttcacctaaagaagagcttcatccagctgccccctcacagctcgcaccatccttctcctcctcttcctcctcctcctctggtcctaggagtttttaccctcgccagggcgctactagcaagtacctgattggatggaaaaaacccgaaggaaccataaactccgtgggatttatggacacgagaaagcgtcatcagagcgatggcaatgaaatagcccacaccaggctgcgtgcctcaaccagagacctccgggcatctcctaagccaacctccaagtccaccattgaagaagatctaaagaaactaattgatcttgaaagcccaactcctgaatcacagaagagttttaagttccacgcactctcctctcctcagtctcctttccccagcacccccacctcacggcgggccttgcacagaacactgtcggacgagagcatttacaatagccagagggagcactttttcacctccagggcgtcacttctggaccaagccctgcccaacgacgtcctcttcagtagcacgtacccttctctccccaagtcgctcccgttgaggaggccttcttacaccttaggaatgaaatcgctgcatggagagttctcagcctcggacagctccctcactgacatccaggagacccgcaggcagcctatgcccgaccctggcctgatgcccctgcctgacactgctgcagacttggattggtccaacctggtagatgctgccaaagcctatgaggtccagagagcctcattttttgctgctagtgatgaaaaccatcgccccttgagtgctgcatccaacagtgatcagctggaggaccaggctctggcccagatgaagccttacagcagcagtaaagactcctctcccactctggcttctaaagtggaccagctggaaggtatgctgaagatgcttcgggaagatttgaagaaggaaaaagaagacaaagctcaccttcaggcggaggtgcagcacctgcgagaggacaacctgaggctacaggaggagtcccagaacgcctcggacaagctgaagaagttcacagaatgggtcttcaacaccatagacatgagctagggaaggctgaggaggacaggagaagggcccagacactccctccagtgagtgtcctgcagcccttattccctccatagaaagcatcctcagagcaccttccctggcttcctactctgccccctttcggggagtgcacaacacaatagttgcagatcaacaatcatcacctgccttttgtagaaaagaaaaacaaaaaaagtaaataaaaattttaaacagtaaaataaaagtttaactgctaaaatgtgaatgtctttatttttttgcacaatatctttatctgttatgtatttaagaagaaactgggccttggaccagggcgccccctggcccatccgcctctattcccatcagctttcttatcaacttcaggtaacccaagctttcccttgttattctaacaaatatcattattcctagaaaaagaatgtttttataacttgtttggggagtagagagggatatttccttaccttcttccctaaaatgcctggagagggagttgctttgagaaaatgcctacctcccttgaatgactcgtgcatgagctagtgctgtctgtacctgtcctccagagatcagcaggaccggagttaaatatttaacagcaagtctgtaaaccagagcagctctgacagtgcctgcaggccacaccccttctcagtcctgcattgtgaggtcatttcctgcttctccctttccccaggaagatggtcccacttgtgctgcaagactcttttttgtttggcttaattgagccccactaaattggaatcaatctctcttacagcttcctggctccaaacattaattgatttcagaattcccccaaactaaaaccttatctgtctgcattttgaatgcattttggtcaaaagtatacgttttaaagatttttaaagataaaaatgtggcacaactggtttttttagcttgctgaaaatgaccatatctctaaattaatctttctctccagagcaagacttcaccagtatttgtaactaggagaagctaacagtgaatgtttaattgtgaattttaatcattgcttgttaggaataatgactgtgatactagaatgggcttttgaaacctgcatgtcccagtgtgaaatttcagcacggcattttctgcatcctttcatggccatccaaaggattccgctgcagaaattattgatgtgctatttttgctgtcttgtgatgcaggctgctttgggcccctgggtcactcttccaaggctgctgtagagcacagagacatggggctggccagtgttgactgacctgaggagacccctttgtttgttgccttcataactgtcactaaaccgacccctctgccctttcagtggcaactctggtctaagggaacattcagcactctagcggcatctgattggaagttccctcacccaagtaatctcaattccttcctctctccatccctgaaagaaacaggatggattttcctctcttctccctgctacattcactaccagatttttatgctacagtttcattcttgattgtgatttctccatggaattttttttttctggtgacatttctatcatggaaataggaagatttcggagtgctttgtgaagatttcaattgtctgtctctttctctctttgacttgtatgaaggagattgtacattgcctgatatctctttgtaaatgagaaatattgctaacatccaagcattctgaagtcttgcttatccttctgagtttagttctcattttgttttacattttgtttggggacttggggcaagctatttattagagttttgcaacagagttcttgtttgaagcctctaaagactacctgtaaaattcaaagaataaaattcattttaaacgctcttttaaaacactttggtattattgcttgaggtttgcttatttgaaagaccacccaataactcattgaccctccttgcatccgaattttttcatcaagctttgttaacactaatgatgattcttgaaaatttctgtccttctcagaatgttaataaacttttttactctgtccacatgtcgatagagaattact

SEQ ID NO: 6086 - DNA, 1231 bp, Homo sapiens
gccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgctgctatttctcatctcgctggctgcacacttgtcccagtggaccaggggccggagcaggagccatccggggcagggacgctctggagagtctgtggaagaggtcccgctgtatgggaacctgcattatctacagacaggacggctgtctcaagacccagagccagaccagcaggatccaactcttggaggccctgccagggctgcagaggaggtgatgtgctataccagcctgcagctgcggcctcctcagggtcggatccccggtcctggaacccccgtcaagtactcggaggtggtgctggactctgagccaaagtcccaggcctcgggccccgagccggagctctatgcctcagtatgtgcccagacccgcagggcccgggcctccttcccggatcaggcctatgccaacagccagcctgcagccagctgagatggagggcctggcacagcggggcgtgcactgccccagccccccgtagcaggggcatgactgtttcccaaccagcacccaaagacgggcgccattgccaagtcacaggatgtgatctaccccggacttcctatctgagcttcaagggagacatctcagggcaaagctttcgtgatggaggaggcaaagacagtagccccctccttatttcttttttctatctgttcctcttagcccccaaactcccaggttctcacttccttcttctggagtttaaccagatcctccccacccccgctccctcatagtctacccccacgcctcagtgtctcctcaggcacaggaagtgggcggtgggggaggggtaagggcctgacagtgggtgggtgggtatattcctcaggagtccacagactggagtggacctggaacttagagacgggagggacccgagcctggcttttgacctaagaaccctagcaggagaatacagtctccatcctgctgtctctgtcctgtccccaagttttcaaataaaactttccaaaaagtg

SEQ ID NO: 6087 - DNA, 3867 bp, Homo sapiens
cgctcgcagagaagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 6088 - DNA, 3996 bp, Homo sapiens
gcggccgctccaggcgcccgttccggagtcggggggaggcccagccgggaggggggaagggggggagccttagtcatttccccgctccagcctgctcccgcccgagcgcgcactcacggccgctctccctcctcgctccgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 6089 - DNA, 3875 bp, Homo sapiens
ggcggcgcagccgcggcccatggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggtacagtccttggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccacatacctggaggctgacgttgccaaaccagccagggaaccaacctgggaagtggccagaactgcctggggtccaagaactcttgtgcctccgtccatcaccatgtgggttttgaagaccctcgactgcctccccgatgctccgaagcctgatcttccagggtggggaggagaaaatcccacctcccctgacctccaccacctccaccaccaccaccaccaccaccaccaccactaccaccaccacccaactggggctagagtggggaagatttcccctttagatcaaactgccccttccatggaaaagctggaaaaaaactctggaacccatatccaggcttggtgaggttgctgccaacagtcctggcctcccccatccctaggctaaagagccatgagtcctggaggaggagaggacccctcccaaaggactggagacaaaaccctctgcttccttgggtccctccaagactccctggggcccaactgtgttgctccacccggacccatctctcccttctagacctgagcttgcccctccagctagcactaagcaacatctcgctgtggacgcctgtaaattactgagaaatgtgaaacgtgcaatcttgaaactgaggtgttagaaaacttgatctgtggtgttttgttttgttttttttcttaaaacaacagcaacgtgatcttggctgtctgtcatgtgttgaagtccatggttgggtcttgtgaagtctgaggtttaacagtttgttgtcctggagggattttcttacagcgaagacttgagttcctccaagtcccagaaccccaagaatgggcaagaaggatcaggtcagccactccctggagacacagccttctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctcatccgtaaagtggggatagtgaagatgacacccctccccaccacctctcataagcactttaggaacacacagagggtagggatagtggccctggccgtctatcctacccctttagtgaccgcccccatcccggctttctgagctgatccttgaagaagaaatcttccatttctgctctcaaaccctactgggatcaaactggaataaattgaagacagccagggggatggtgcagctgtgaagctcgggctgattccccctctgtcccagaaggttggccagagggtgtgacccagttaccctttaacccccacccttccagtcgggtgtgagggcctgaccgggcccagggcaagcagatgtcgcaagccctatttattcagtcttcactataactcttagagttgagacgctaatgttcatgactcctggccttgggatgcccaagggatttctggctcaggctgtaaaagtagctgagccatcctgcccattcctggaggtcctacaggtgaaactgcaggagctcagcatagacccagctctctgggggatggtcacctggtgatttcaatgatggcatccaggaattagctgagccaacagaccatgtggacagctttggccagagctcccgtgtggcatctgggagccacagtgacccagccacctggctcaggctagttccaaattccaaaagattggcttgtaaaccttcgtctccctctcttttacccagagacagcacatacgtgtgcacacgcatgcacacacacattcagtattttaaaagaatgttttcttggtgccattttcattttattttattttttaattcttggagggggaaataagggaataaggccaaggaagatgtatagctttagctttagcctggcaacctggagaatccacataccttgtgtattgaaccccaggaaaaggaagaggtcgaaccaaccctgcggaaggagcatggtttcaggagtttattttaagactgctgggaaggaaacaggccccattttgtatatagttgcaacttaaactttttggcttgcaaaatatttttgtaataaagatttctgggtaataatgagtc

SEQ ID NO: 6090 - DNA, 1659 bp, Homo sapiens
atgcctgtcccagcctcctggccccaccctccttgtcctttcctgctgctgactctattgctgggactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgccttgggactggccataaaccacagactctctccaggctctcaagagttatcctgtcttctggattcctgcctaccccaactcccccagccttgttgaggttctctactgcctcctgaatacacatgaacccctataccaattttaagaaaaaaatgattctctttcctctttgtccaagcatcctatccctcaaacccaaaaagaaagaagctctcccttctctctctgtgatggagacagtatttcttctagtatcctgcagccttcccagtcctgctgcttgtggtagaaatgctgccacagcccaacattgaggagccctcgatgactgccctttacaactcatattcagttctgcctccaaaatgcatgtgtccacttacatgagatggtaaatgtttaacaatggactttctgaaagggaaaaaccaaaagctgttttgcagtgcttgccaatttctctagtgtaataactcccaacctgaccaatttcacactgccaacagttaaacaaccagattgcaagattcctgaaatttaacaattggttttcagggcccagtccaagcctgctgctggaaacctcagagttaaatccctattctccacacctctcacctccaccacccctccctgtcccagccagcatcatctctttggggaccactcctctggctttcatttttcagccacagtgattctttggaaaagtcaaatcatatcacttctctgcttcttccccaacacagctgcatggctcccgctctccctccttcaagtctctgctcaatgtcacttcattaaaggcaccttctataaact

SEQ ID NO: 6091 - DNA, 2207 bp, Homo sapiens
agagcagagtctgcgatcttcccagcacagacgtttggacagagcaggctcctaaggtctccagaatgcccgtgccagcctcctggccccaccttcctagtcctttcctgctgatgacgctactgctggggagactcacaggggtagctggcgaggaagagctgcaggtgattcagcctgacaagtccatatcagttgcagctggagagtcggccactctgcactgcactgtgacttccctgatccctgtggggcccatccagtggttcagaggagctggaccaggccgggaattaatctacaatcagaaagaaggccacttcccacgggtaacaactgtttcagacctcacaaagagaaacaacatggacttttccatccgcatcagtaacatcaccccagcagatgccggcacctactactgtgtgaagttccggaaagggagccccgaccacgtggagtttaagtctggagcaggcaccgagctgtctgtgcgtgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgcaggagacagtgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtccaggacagaaacggcctcaacccttacagaaaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaatactgctcctggcccagcactggcttctgctgctccacttctcatagctttcctcctgggccccaaggtgctgctggtggttggtgtctctgtcatctatgtctactggaagcagaaggcctgactgcatcccagaaggagaccagcaccaggaatacaacagcctcccaggaaatgtttcttaaatgatgagcagatgattaaatatggacatgttacccacagctccttccctcctcccctgccacatggaacccccagtctctcctgcctacttccttccttgaatggctctgactgagagaaggggctggtgagaagcttccccagactgagctccaaacacctcccctcccaggacatcttcctgcccacaggctcctgttgctcctttgcagagtccttgattctccagagcagtcttcattcatggtcctgagcagaggccatgggatggggctctggggagtgactcatgacacctccctaggatgtgggaaacacgccaaatctaaacacatcaggacacctctcctccatcgtcttggactctccgtaagccacaaactgcagtccagattctcaagagttattctgccttctggattcctgcctacccaattacccagccttgttgagattctctattgcctcctgaatacaaattaacactcatcctggttttaaggagaaaaatgattatccttcctctttgtttatacgtatgatataatttggatattttttccctacaaatctcaatgtgaaatttcatcccctatgttggaggtggggtcaggtgggaggtgtttgggtcatggggatggattcatcatgaatgacttggtgttatcttggtctattagcacccacaagatctgattgtttaaaagtgcctagcagctccctcttctctttttctcttcctctctccccatgttatgccaactccacttcactgtccactgtgagcagaagcactctgaggccctcagcagcagatgcaagtaccatgcttcttgtacagtctgcagaaccaaaagccaaataaacctctctttataaatta

SEQ ID NO: 6092 - DNA, 656 bp, Homo sapiens
agcacagacgtttggacagagcaggctcctaaggtctccagaatgcccgtgccagcctcctggccccaccttcctagtcctttcctgctgatgacgctactgctggggagactcacaggggtagctggcgaggaagagctgcaggtgattcagcctgacaagtccatatcagttgcagctggagagtcggccactctgcactgcactgtgacttccctgatccctgtggggcccatccagtggttcagaggagctggaccaggccgggaattaatctacaatcagaaagaaggccacttcccacgggtaacaactgtttcagacctcacaaagagaaacaacatggacttttccatccgcatcagtaacatcaccccagcagatgccggcacctactactgtgtgaagttccggaaagggagccccgaccacgtggagtttaagtctggagcaggcaccgagctgtctgtgcgtgtactccaggtgaaagagatcaaaatcccacggaccctggcttcagttgttatccaggtctatctactgcaacatcctgtggcttgacctctagcagccaaaccctctgcccccgtggtatcgggccctgcggcgagggccacacctcagcacacagtgagcttcacctgcgagtcccacgg

SEQ ID NO: 6093 - DNA, 1715 bp, Homo sapiens
cgatcttcccagcacagacgtttggacagagcaggctcctaaggtctccagaatgcccgtgccagcctcctggccccaccttcctagtcctttcctgctgatgacgctactgctggggagactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgccttgggactggccataaaccacagactctctccaggctctcaagagttatcctgtcttctggattcctgcctaccccaactcccccagccttgttgaggttctctactgcctcctgaatacacatgaacccctataccaattttaagaaaaaaatgattctctttcctctttgtccaagcatcctatccctcaaacccaaaaagaaagaagctctcccttctctctctgtgatggagacagtatttcttctagtatcctgcagccttcccagtcctgctgcttgtggtagaaatgctgccacagcccaacattgaggagccctcgatgactgccctttacaactcatattcagttctgcctccaaaatgcatgtgtccacttacatgagatggtaaatgtttaacaatggactttctgaaagggaaaaaccaaaagctgttttgcagtgcttgccaatttctctagtgtaataactcccaacctgaccaatttcacactgccaacagttaaacaaccagattgcaagattcctgaaatttaacaattggttttcagggcccagtccaagcctgctgctggaaacctcagagttaaatccctattctccacacctctcacctccaccacccctccctgtcccagccagcatcatctctttggggaccactcctctggctttcatttttcagccacagtgattctttggaaaagtcaaatcatatcacttctctgcttcttccccaacacagctgcatggctcccgctctccctccttcaagtctctgctcaatgtcacttcattaaaggcaccttctataaacta

SEQ ID NO: 6094 - DNA, 3241 bp, Homo sapiens
agagcagagtctgcgatcttcccagcacagacgtttggacagagcaggctcctaaggtctccagaatgcccgtgccagcctcctggccccaccttcctagtcctttcctgctgatgacgctactgctggggagactcacaggagtggcaggtgaggacgagctacaggtgattcagcctgaaaagtccgtatcagttgcagctggagagtcggccactctgcgctgtgctatgacgtccctgatccctgtggggcccatcatgtggtttagaggagctggagcaggccgggaattaatctacaatcagaaagaaggccacttcccacgggtaacaactgtttcagaactcacaaagagaaacaacctggacttttccatcagcatcagtaacatcaccccagcagacgccggcacctactactgtgtgaagttccggaaagggagccctgacgacgtggagtttaagtctggagcaggcactgagctgtctgtgcgcgccaaaccctctgcccccgtggtatcgggccctgcggtgagggccacacctgagcacacagtgagcttcacctgcgagtcccatggcttctctcccagagacatcaccctgaaatggttcaaaaatgggaatgagctctcagacttccagaccaacgtggaccccgcaggagacagtgtgtcctacagcatccacagcacagccagggtggtgctgacccgtggggacgttcactctcaagtcatctgcgagatagcccacatcaccttgcagggggaccctcttcgtgggactgccaacttgtctgaggccatccgagttccacccaccttggaggttactcaacagcccatgagggcagagaaccaggcaaacgtcacctgccaggtgagcaatttctacccccggggactacagctgacctggttggagaatggaaatgtgtcccggacagaaacagcttcgaccctcatagagaacaaggatggcacctacaactggatgagctggctcctggtgaacacctgtgcccacagggacgatgtggtgctcacctgtcaggtggagcatgatgggcagcaagcagtcagcaaaagctatgccctggagatctcagcgcaccagaaggagcacggctcagatatcacccatgaagcagcgctggctcctactgctccactcctcgtagctctcctcctgggccccaagctgctactggtggttggtgtctctgccatctacatctgctggaaacagaaggcctgactgaccctcagtctctgctgcctcctcctttcttgagaagctcagcctgagagaaggagctggcgagaaccttccccacactcagctccaaacgcctcctctcccaggtcatctgcctgcccacacgctcctgttccaccttcacaagaccatgatgccccaaagcagtgtctctattcacggtcctgagcaggggccatgggattgggctctgggcactgactcatggcacctccctagaaggtgagaaacactccaaatctaaacacaccaggacttctcccatccgtcgccttgggactggccataaaccacagactctctccaggctctcaagagttatcctgtcttctggattcctgcctaccccaactcccccagccttgttgaggttctctactgcctcctgaatacacatgaacccctataccaattttaagaaaaaaatgattctctttcctctttgtccaagcatcctatccctcaaacccaaaaagaaagaagctctcccttctctctctgtgatggagacagtatttcttctagtatcctgcagccttcccagtcctgctgcttgtggtagaaatgctgccacagcccaacattgaggagccctcgatgactgccctttacaactcatattcagttctgcctccaaaatgcatgtgtccacttacatgagatggtaaatgtttaacaatggactttctgaaagggaaaaaccaaaagctgttttgcagtgcttgccaatttctctagtgtaataactcccaacctgaccaatttcacactgccaacagttaaacaaccagattgcaagattcctgaaatttaacaattggttttcagggcccagtccaagcctgctgctggaaacctcagagttaaatccctattctccacacctctcacctccaccacccctccctgtcccagccagcatcatctctttggggaccactcctctggctttcatttttcagccacagtgattctttggaaaagtcaaatcatatcacttctctgcttcttccccaacacagctgcatggctcccgctctccctccttcaagtctctgctcaatgtcacttcattaaaggcaccttctataaactaccttgtataaaatattatttattttctctatcccggcattctaatttctcttatcctaattaatttttctttagcccttattttgatgagtattatgccgaatacaggcagccctcacttttcatggcagtgcaagattgcaaaaatgactgtgcaacctgaaacccaggaaagcagtctccatagtcaatcagaaaaacaatgatcattctgtgacctttaccattttttgtcaaaatattagaaactctcacactctcagttacaaatgtagaggacaatgaaaatataatgaaataaatatttatttgtgcactacaattcaaagcattagaaacattgagagttcaagtgctgtttctttgtaaaaatgtatccagagtagttggaagagtgcttgcctttttttgtatatttctaatatggagtgatatagtttggctctgtgtctccatccaaatctcatcttaaattgtaatctgcatgtgttgtgggatgggcctggtaggaggtgactgaatcatgggggcggacttcccccttgctgttcttgtgatagtgagttctcataagatctcagtgagttctcatgagatctggttttttgaaagtgtgtggcaagtcccccttcgctctctctctctctctccctcctgccaccatgtgaagaaggtgcctgcttccttttctccttccaccatggttgtaagtttcctgaggcctcccagtcatgcttcctgttaagcctgtggaactgtgagtccaattaaacctcttttattcataaaatatccagtttctggtagttctttatagcagtgtgagaatgggctaatacacggagcaagcattgtttcttttc

SEQ ID NO: 6095 - DNA, 2298 bp, Homo sapiens
taaagtgtcgagcttctcctcgcgagagacttagtgctcatgctcgctgcaggggtcggaggtcagggcgagcgtctcgcaggccgtaggaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcaaccttgaaagaactgacaagcttagtaaaagaagtctacccagaagctagaaagaagggcactcacttcaattttgcaatcgtttttacagatgttaaaagacctggctatcgagttaaggagattggcagcaccatgtctggcagaaaggggactgatgattccatgaccctgcagtcgcagaagttccagataggagattacttggacatagcaattacccctccaaatcgggcaccacctccttcagggcgcatgagaccatattaaattctatttactatttgttgaatttatttttccgtcagttatgtaaaataaacatactcttcttcctcccctgattattgccattaagcctttaaattctaaacaaattataatgcatcatctatttaggagttagatttggatgtgctattgtatgattacgaatagtctgtatgtttcaagcccttctgtaaaatatgaagaaaagtgctcttagcattctgtgtaaaactgtactgttaaatatatgtgtgtaatcagcctgagtgtgaaagttaatggaggcctgggaacagggtttatactaagtagtggaggagcgtatggttaagcccaaaggggcagaacaagaaagccacgggattgtatgaaatcaaacatgagtttgtggtgtagactgctgtatgcagttggaaaggacacgtgagagtgagctcaagtggcagcagaggcagtttggaataagctgcggcaagttgaagaagctgtgttggacgagattgccccgccttgatcagggtaccatgacataaaaggttaaagaacaggcaacacaatgagcacttaagtttttaacatgtggggaatagggcattttaaaggctggaaccagttcagaggaaacaagggtttgggtagaggtagaaaggtttaattaaccctggagatctgcaaatggagggaggggtgaaggaggaatcttaagaccgagggagaagagccaaggacaaggtcaggttgaatgagtaggaggtgttcacacatcctcttgtgtgctaggtagtggcgtgcatctgatctgagaggcagtaaagcagtgatgaagacagtgcagcagaacattgaagtcctgattgcagcagtgactctgcaaccttggataaattatttcaatctttattttgtaaaacggagataacggcctataggattgttaagactgaatattttaaaagagcttagaatggtgcctgacaaatgagaaacaataaatactgattattggccataaagtggtattaaaactggatctcttttcttccatggcactactctcattttgaagtttatgaacagtacgacagtgtattgtaaattccctttagtttgttacagtagccaattgaaaatgtatatcccaaaatttaaaaaaaaaagtaccagcagcaataaaattgcactagttttatctggtacatacaaaaacagccatttaaaatctgatgattctgtggaattggtgtccctgttagcaatggcagagaccagcctggagcctagatctggtgcttcttctgtgctgtggtttaccccaaacctttaggttgtttattcattcagattagatagactggagccataaagttaatttgcacctagctttttggagaatagccatgattaactgctattcgtggtgggggtgggggggaaccctatgatttactatgcagatgaagagggtaggaactaaataaaggactttgtaagccaaagtggttgggctgctttgtcaaattccaccctttgcttggttccaacatggaatttctcctttaaagatttcaatatcccatcaaaagtacagttagagaatacctagtgaatttattgaatataatgctaagaatcaaaagacttgtactagtttacctctggctttggtaagtgtggctttgagtaataactgagctgtttccccgcatataaaatagaaataaataagtagtcatcatgaca

SEQ ID NO: 6096 - DNA, 1313 bp, Homo sapiens
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtggctgaagccatactattttatagaattaatggaaagcagaaaagacatcacaaaccaagaagaactttggaaaatgaagcctaggagaaatttagaagaagacgattatttgcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaagga

SEQ ID NO: 6097 - DNA, 849 bp, Homo sapiens
ctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaa

SEQ ID NO: 6098 - DNA, 1156 bp, Homo sapiens
cttttctcaggaccatcagtcaggctctttgtgtctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatatatgtgtctaccgatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaa

SEQ ID NO: 6099 - DNA, 1682 bp, Homo sapiens
gaagcacccggcccggatcgcagagcccgcgccctgcgccggcggcaatgaagatctggagctcggagcacgtgtttggccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgacccgcgccgcccccgcccgcccgcccacgctgtcctccacttaggctcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctggat

SEQ ID NO: 6100 - DNA, 1716 bp, Homo sapiens
cccgcccacgccgcgcccggagccgcgcggcccgaagcacccggcccggatcgcagagcccgcgccctgcgccggcggcaatgaagatctggagctcggagcacgtgtttggccacccgtgggacacggtcatccaggcggccatgcgcaagtacccgaacccgatgaacccgagcgtgctgggcgtggatgtgctacagcgccgcgtggacggccgcggccgcctgcacagcttgcgcctgctcagcaccgagtgggggctgcccagcctcgtgagagcgattttgggaaccagtaggacattgacatacatccgagaacattctgtggtggatccagtggaaaagaaaatggaactttgttctaccaatatcacactcacaaatttggtgtcagttaatgagaggttggtgtacacacctcatccagagaacccagaaatgaccgtgctcacacaagaagccatcatcactgtgaaggggattagccttggtagttatttggaaagtttaatggccaatacgatatcatccaatgcaaagaaggggtgggctgctatcgagtggataattgaacactctgaaagcgctgtgagctaaggaggcctgtgcctgtgcttgtcataaatggtgatgcttcccagaagaaaggaaagaaggaggtgaggagaggacgagcaaggacgggacggaaaagcacgtctggctgcgagggcacacagggccggggaggaggattaggctggactgatcgcgggtcgcaggtgaccccgggaccagatgtccctcccctcatgagcgtgcaacagggagcagccccagccagccccaccgccgccgtctgcgtggatggagggctcgaggccctcgcccgtgtcccttaggggcggcgcccatcgtcctgcctgccgcagtggcccagccccttctctccctgcaggtgacccgcgccgcccccgcccgcccgcccacgctgtcctccacttaggctcctccacaaacgctggcgggtgtgccgccctccagcctctccgcccccgtcccctcggtcctgcagatcaccaagcagctctcctgggcccgcggctgctccgggcctcacatctgctgctggcctcggtgggctctgactgcggggctcacggggcctggggccatggctttcttctcggcccccaaatgcctttcctggagtggctaagcctctcctgacgaggctcctcatgcggggagagggctggggtccaggggtttcccggccctttctgcaggctgtgccagccccctccagtctgccactgccgtgcccgggggacatcctgcgcccaggctggaggccctgcctcgctgcttgccagcctcacctgctggggctggaggccatggatccctcatagtatccaaggtttgagttcctgtttttcgccttatagttttgtgagtgtttgagggacaacgaccaaaggtcttttccccaccatctttaaatcaaagttgtttaaaacaacattaattttaaaaaatacataaaagcaacccatgcttatggttaaaaaagagtacaggagtctggagtccgttgaagggtaaaggcctcccgcaagctgccagtcggctctttttcgcaaagccttccagaagttttctgtgcttatgaaagcgtatgtgtggcctttctcttcccttcttttattaaacacagataggtttatgctgg

SEQ ID NO: 6101 - DNA, 2626 bp, Homo sapiens
aaaacccgggccgggatagggcgtggggccgcgcgtctggacgtccctcgcgtcgggcccgacagcgcctgcgcactgcgccgccggctggggtgctgggggcggggcaggggcaggtgtagcctctgtgcctcgttgtcccctggcgctacccggacatctctcagggtgccggcaccatgaagatctggacttcggagcacgtctttgaccacccgtgggaaactgttacaacagctgcaatgcagaaatacccaaaccctatgaacccaagtgtggttggagttgatgtgttggacagacatatagatccctctggaaagttgcacagccacagacttctcagcacagagtggggactgccttccattgtgaagtctcttattggtgcagcaagaacgaaaacatatgtgcaagaacattctgtagttgatcctgtagagaaaacaatggaacttaaatctactaatatttcatttacaaacatggtttcagtagatgagagacttatatacaaaccacatcctcaggatccagaaaaaactgttttgacacaagaagccataattaccgtgaaaggagttagcctcagcagttaccttgaaggactgatggcaagtacgatatcctcaaatgctagtaaaggccgagaagcaatggaatgggtaatacataaattaaatgctgagattgaagaactgacagcctcagcaagaggaaccataaggactccaatggcagcagcagcgtttgcagagaagtgatcgtgacagttggtagacaacatcgggtactccaggtctctccaaactgactatatatttatttgttattttaaaaatacaactatattttgggtagtttttttttttttttttttgataagttggtgtaaggctatgtgacttgatcaaaacagatgcagggcctctaaataaaagggatcatctgaaattaatgttgtttgaaattactatctgattttgagggttccagtatttctgtgaaaattcaacaagaactccttggaaactggtattgatattcagtctccttaaggtagatttttcaagcttttcatacattggaactccacctgactttggaccaaccccagaacagagcagagccacctcctatagacgcccattgccctgctgctgtacacttcagcagcttgcacaagggagctcacttaaaaggagaaattgtgtagttttaaaatatattttgtgtaaaataccttactatgctataaaccaccattaaaaaccagtgttttgatttggtacttaaatatttttggagtgaaaattatcactaaagtaacatgactccaacaaaagtatggtttcattataaaagagtactgtattgatttgcccaagttttgtaacttagtaaaggtattaacttccttggatttgtactttgtgatttagtatgctgtatcgtgggctggttatgttaactgaaaaaaataaagtcattacctgagttttgcagtgctctaacttaaacagaagaacagctgttcacatcttttagcattttacatttgcctaacttaaaaattgccatgtgtcaaaatcatggttttgtaattgctaaggcatgatatgtcaggttatttgaatataattactttttgaagtaattgtgaccacaaaacatcttttttacatgaaggagctgtgtatcatttgaaattactcaaatgatgtcttgctctgaggcataaatcccaggtacttagtgtttttaataatatggtgccactgcaggatttgggggcggtggggaagaacaagcataatggtagggggaggcttggcctgaaactaaccactgagtgaattgcactgcaggttttacttaacgggaattccttatttgggatgtcaagagggcagctgcaaactgaaaaacaatccagtaaatgtactttgttttatgtattgtagcaggcaattaactactaaataatagctttgacatttgcaattgttgcatagagactatttttgctagaagatgattagctcttgcctttattttacagtgcttagtgtgataaacttctagtcatgtttcctatccaagagaccagttaatatatgtacataaaccacagaaatagtataacacactatttttaaattatcgttttcctacttaaattttgtttagcttaagacttcttaggacatttgtaaaagcaggttaaatttaataaggtttctgatttttttttgtaaccggagatagtttttacaagtgaaataacatttcagctaaataaaacatcgctaaataattgatatttgatgaaaatctgctttgtataatttctgtaaattatccttgttctgaaaaaggtgtaatgccctaatatttttaaatccttatcctttgattttttaaaaactgacctattgataaaactataaattttcattttccagtgcagttagttacctttttaaacataaatgcacaacaagcaaatgaatttaagagaactaaactggaataagtgttcataaatgaaacccttggactatttaataaagttgaaatgtgaattaaggaaaacttttgttaataaaaactttcttttaagtga

SEQ ID NO: 6102 - DNA, 3866 bp, Homo sapiens
gagttctgctccggcgcccccgagcaccgcccgcttcagccgaccagccccgtcggctactgggcctcgccgagacgagaggagggaaaggcctcggcggccgcgaggaggcggcgggggcgcgggcggaggcggcgcgggcggccgcggctgccgctttgttgtgcggcccgggccgaggaaggagaagtgggaggaggggggagctcggcgtcccgctccctccgcggctcatggcgacgactctcggcacatccgggaccctccggccgtggcggccgaggcgccggctgctcgggccccagccccggccgctgtggtgactccgccgcgcctcgccgtcgcccccgtgccgcccgccgcccccgccgcccccgccgccggggacatgtctaaccccggaggccggaggaacgggcccgtcaagctgcgcctgacagtactctgtgcaaaaaacctggtgaaaaaggattttttccgacttcctgatccatttgctaaggtggtggttgatggatctgggcaatgccattctacagatactgtgaagaatacgcttgatccaaagtggaatcagcattatgacctgtatattggaaagtctgattcagttacgatcagtgtatggaatcacaagaagatccataagaaacaaggtgctggatttctcggttgtgttcgtcttctttccaatgccatcaaccgcctcaaagacactggttatcagaggttggatttatgcaaactcgggccaaatgacaatgatacagttagaggacagatagtagtaagtcttcagtccagagaccgaataggcacaggaggacaagttgtggactgcagtcgtttatttgataacgatttaccagacggctgggaagaaaggagaaccgcctctggaagaatccagtatctaaaccatataacaagaactacgcaatgggagcgcccaacacgaccggcatccgaatattctagccctggcagacctcttagctgctttgttgatgagaacactccaattagtggaacaaatggtgcaacatgtggacagtcttcagatcccaggctggcagagaggagagtcaggtcacaacgacatagaaattacatgagcagaacacatttacatactcctccagacctaccagaaggctatgaacagaggacaacgcaacaaggccaggtgtatttcttacatacacagactggtgtgagcacatggcatgatccaagagtgcccagggatcttagcaacatcaattgtgaagagcttggtccattgcctcctggatgggagatccgtaatacggcaacaggcagagtttatttcgttgaccataacaacagaacaacacaatttacagatcctcggctgtctgctaacttgcatttagttttaaatcggcagaaccaattgaaagaccaacagcaacagcaagtggtatcgttatgtcctgatgacacagaatgcctgacagtcccaaggtacaagcgagacctggttcagaaactaaaaattttgcggcaagaactttcccaacaacagcctcaggcaggtcattgccgcattgaggtttccagggaagagatttttgaggaatcatatcgacaggtcatgaaaatgagaccaaaagatctctggaagcgattaatgataaaatttcgtggagaagaaggccttgactatggaggcgttgccagggaatggttgtatctcttgtcacatgaaatgttgaatccatactatggcctcttccagtattcaagagatgatatttatacattgcagatcaatcctgattctgcagttaatccggaacatttatcctatttccactttgttggacgaataatgggaatggctgtgtttcatggacattatattgatggtggtttcacattgcctttttataagcaattgcttgggaagtcaattaccttggatgacatggagttagtagatccggatcttcacaacagtttagtgtggatacttgagaatgatattacaggtgttttggaccataccttctgtgttgaacataatgcatatggtgaaattattcagcatgaacttaaaccaaatggcaaaagtatccctgttaatgaagaaaataaaaaagaatatgtcaggctctatgtgaactggagatttttacgaggcattgaggctcaattcttggctctgcagaaaggatttaatgaagtaattccacaacatctgctgaagacatttgatgagaaggagttagagctcattatttgtggacttggaaagatagatgttaatgactggaaggtaaacacccggttaaaacactgtacaccagacagcaacattgtcaaatggttctggaaagctgtggagttttttgatgaagagcgacgagcaagattgcttcagtttgtgacaggatcctctcgagtgcctctgcagggcttcaaagcattgcaaggtgctgcaggcccgagactctttaccatacaccagattgatgcctgcactaacaacctgccgaaagcccacacttgcttcaatcgaatagacattccaccctatgaaagctatgaaaagctatatgaaaagctgctaacagccattgaagaaacatgtggatttgctgtggaatgacaagcttcaaggatttacccaggactctatttatacaaccctgactgacagcctcctttcagcagagtttcaaagaatatgctgaaatacaggaaaacactccccccccccccctttttttttttttttttacattttaggacactgtgaggggaaaggacaattttgaaattccttttcaaggaaaaaaaaggtctttatgctttgccatgaggccacattcagctgctatttaaacttaatatcttgaacctaaagaatgctgacttttcctacatttccagagttaggcagtattctacacttaaagactactactatttttataaaaggtaatctattcaaatttcttcacagatttcaagtctctcaaacatcaagacaacttcagcagtcggtacaagtcacatttcattttgattgaatacatgatcttgaacagctcctgtacttgctctttgtaaaaaaaaataaaattattttgaattattctacctttgtaaacaattggctaaaagaatcatctttaagaaattaagccatttacatgtttgtgtttttctatagcagagcattatattttgcattatatgtttcaacctagtctaagtgggtcttttttacatttttcaagaacggatttcctggaatacagcgatataattttggttgtcaaattcctaatgcaaccatttagtctaaacttagtcatttatttgtgacaataagatgtgttcaggggctccctgtttttaagagactcttttaaaaaaaaaaaaacctaatgtttttatcttgagtcaatatgattaggtattttggatttacttttaatcttaaaatactgcatttttatagcttctcagagcatgtggatgggatgggattttcgttattttgctgggtcagcttatctttaatatatggactattcctataaaccaaagtctctgacaagtgcacctaatttatattgtattttaactacagtgtaagtttccattaacaaaaccatcctaaagcgttaactgctcataattttaatcagctacagttatgaaaaaggaagaattttgctctaaagattattaataagcttagaaaatcctgcttttacctaacagaatgaagtggggttgaggggcggtagtatgaacagtgattctaactctatggcgtaaattactttgaagagttcattttggaagtaagggaatcccgcttcccttgg

SEQ ID NO: 6103 - DNA, 1087 bp, Homo sapiens
ggcctctgcgccaaccccgcgcgccacccgcggcttcctccgctcggggtcctcgttcggcctctgctggcctccgcgactccgcggtgcccgcccccgttgagttcaaaaggacgcgcggagcggcgccggcccttcaccagcagcccgtccgactggaaagatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatc

SEQ ID NO: 6104 - DNA, 1076 bp, Homo sapiens
acattcgccgcagccacctcggccgtggcaggaaccgaaacccggagcggccgaagctcagcgctccgctggggcagagggtcgcggcggctgggaacgccgctccccgacgcaccggccgcccccagcgcagcgcgctccgcggggtgctgatctgcctcttctccaagaaactcaaccactagtgacaatgaccagcctcctgactactccttctccaagagaagaactgatgaccaccccaattttacagcccactgaggccctgtccccagaagatggagccagcacagcactcattgcagttgttatcaccgttgtcttcctcaccctgctctcggtcgtgatcttgatcttcttttacctgtacaagaacaaaggcagctacgtcacctatgaacctacagaaggtgagcccagtgccatcgtccagatggagagtgacttggccaagggcagcgagaaagaggaatatttcatctaatgactcccaggccccaaggagcttattcctggctccatcgctaacacgttgactgcttattatgggaaagttttctctgaagccagggagaagcattgattgatgtgggcaaatccaagctccagccaggtcgcagtcccaaatgccgacatcactgactccagggaccagggacatggagaaagctgtttatgatatctttaaccaggccctcttactagagctggtgtttgtgactggccaacaagatgtggctatgccaggggacatctgagtatgtgcccagtcatcttttttcacaggttgaagggagagaaaagattttgagttaaggtcattggctgctctactctgtcccctacctggtcacctagtgatagccccagtggagatactgtccatacaaggtcttcccagaggctggataccacagtaaaaggccaggccaggaggggtaggagactatggagatcttacctcctgataaatgtgctacaccccctaatctgagcccttcctttccgtgttccccaacaacctcatgcttacgtgatttttattcaaattaaaaattttcattgctacagaaatc

SEQ ID NO: 6105 - DNA, 6643 bp, Homo sapiens
ctaccgccgccaccgccgccaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagcggaacacccccacggtgctgcgacctagggatggcagcgtggatgacaggcagagcagcgaggccaccacatctcaggatgaggctccccgggaggagctggccgtgcaggacagcctggagagtgacctcctggccaacgagagcatggacgagttcatgtccatcacgggcagcctggacatggccctgcctgaaaaggacgatgttgtgatggagggctggaggagcagcgagacagagaaacatggccaggcggacagtgaggacaacctctcggaggagcctgagatggaaagtctcttccctgccctggcttctctggctgtgactacttctgccaacgaggtgtcccctgtgtcttccagcggcgtcacctactctccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgaggggcacctcaccccggcagcctcagccaagctgcccctgccccgctcctctgcttacttttcctcctggctggatgggcaccccgggagcggggtcctggtgtctgttcacaagcgtggagttcagtgcgcaaagaaactaccctgacttttacttctgggcagatggggtggagggagtaccccttcaattcagccttacattttcctgtttgaccaaagattgcccaagtctggcgttcctcccttgcaggaggtggaggttgttggtggaggaggagccatctttgtttgctggtgcccggaatggtctcctcttcttctttccctatccctccaaactgtcttgtaagatgagacctggggaggaaacttctttttggaaattggtgtagaagaggtgtgtggggctacctctatgctcctctgcaaggggcctttggcgatgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttgggaggctaaggtgggcggatcacaaggtcaggagttttgagaccagcctggccaacatggtgaaaccccatctctactaaaaatacaaaaattagctgggtgtggtggcgggtgcctgtaatcccagctacttgggaggctgaggcaggagaatcacttgaacctgggaggtggaggttgcagtgagttgagatcacgccactgcactccagcccgggcgacagttcaagactccatctcaaaaaaaaaaagaaaaggcacacaagagtccctcacacatctctcttggagtctgggattccatctgttgtattttctccttttttctcctctgtctgatgccagaagatacttgttttcttcttttcaagaaaagtatctccccacataggcggtggacccaaaaagtgtaggcatgagacggtcagagctctttggggtcctgctcagagtcccccaggcagggcagagtctgtatcctgctgccatcttgcaagggaaaaccgcctctccttccaagtattgggtcttggaaaggtgtgtgtttggtgaaagccacttaatggtggtggggtgcagcttttctctaagtgcagttactcactcaggacaaaggaggaaaaggaaggcagaggtcagccagggtagagggtgatgtctgttttccttgggaaacatctgctgatgaactgggtccagggccgtgctaggtctgggaacaatcctctccaggtcttcacacagagtatcaccaatccacaaacagacccgaagtgaactagtttactctgcctacctgtcctttcaatagagcagtctttcccgctcttctgttctgagaatgcacccggaatgggggaaacccagcaagcagcagagagaaaggctcttcccgggagacctgccgcctctagggtggtcagagaatagcagctgggattttggagagggagaggataggtaaagcagcgtattgaagcatttgcggaggggtgtattagtcctcccaccctgagcacaccaggacggggatgcatccttgccttgtgtgcttgtaaaggcttctttcccttggtatagcaacttcaactgcacctgaacctccaacctctgcccagcctctggtgcagggtggatagaggtctagccagcccttacttcctgaagagagctctgtgggaaactcgaggctacagtagcttcccggctcccagctcctaccctacccccaccaaagcagaaacgggagacggcaacgttctggctgccattagacttacgtctccctcccctacgtcccctagcttcccaagacaggaagaaatgtgcaaaaggcccctccggagaaaactattttgccgttcagctgttctttacagaggatgttattttagtgagacccaggtcctagaccttctgattcctatttatttttttaacagactagtctcaaagtacagcacaaaatctcttctctgccttctcttgtgatgttccagagagcatctgtggttgtgatttggaataagtcatatttatttggtttactgtgcctattcagatctctgtatgttgtgtgtgtttctgtgtcctggaattggatgcgtgggactcgttctgtccgcggagtgcactctttttttcagtgtggcccacatatcttgtaaatgtttgctgaagagttgtgtctatatatagagaaaatatatataaacagagaaatatgtgaatctgtttttttttgtctttttttttttaatttgaaagaaaaaaatgcttgcttctgaggactgtgtcctcccactcacaccccagtgaccctatatggggtcagatttttgtaatagctgcctggccttttcccagaaaaggtgaatcacttctgacttcttgtattagctggctcttaccacaagtaatgctgcattacaaatgacccaaaaagtagtggtttaaaacagccatgtatttacctcataattctgtgggtcagcatcccaggctaggttcagctaggaggttcttctgttctcagacttcttcatgtgtctgtggtcagctgatgtccagataggcaactctgcttctgatggttgtctggctgttgactagggcagtgggggaaactggattccgtatcttgcatcctccagcaggctagcttaggcttgtttacatggctatgatagcagatcccagaaggtaagcagaaacacacactgtctcttggtctcagcttctctggcataaagtcatttctgccacattctgttggtcagagtaagtcacatgactcagcccagcttcatagggtagggaaatagactgtacttcctgatgagaatctttggaaagtgacactgaaaaggagcatgggccaggcacagtggcttacccctgtaatcccagcactttgggaggccaaagcaggaggatcacttgaggccaagagttcaagatca

SEQ ID NO: 6106 - DNA, 4317 bp, Homo sapiens
cggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgagggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgttgcccccgacttcttgggcagcacttcctccgtctctgtgggccctgcctggatgatggttcctgcaggccggtccatgctggtggtggccagagggagtcagtgggagccagccagatgggacactactctccccacgccaagcccgaaggagcagccccccatgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagaggtggacgagcagattcatgcctgctatgcacagaccatggctgagtggctgggctgcgaggcgatcgtgcggcagagggagcgggagtcccatgcggccgccctggccaaatgctcatccggggccagcttggacagccacctgcaccggatgttgcacagggactcaaccatcagcaatgagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagcggaacacccccacggtgctgcgacctagggatggcagcgtggatgacaggcagagcagcgaggccaccacatctcaggatgaggctccccgggaggagctggccgtgcaggacagcctggagagtgacctcctggccaacgagagcatggacgagttcatgtccatcacgggcagcctggacatggccctgcctgaaaaggacgatgttgtgatggagggctggaggagcagcgagacagagaaacatggccaggcggacagtgaggacaacctctcggaggagcctgagatggaaagtctcttccctgccctggcttctctggctgtgactacttctgccaacgaggtgtcccctgtgtcttccagcggcgtcacctactctccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgaggggcacctcaccccggcagcctcagccaagctgcccctgccccgctcctctgcttacttttcctcctggctggatgggcaccccgggagcggggtcctggtgtctgttcacaagcgtggagttcagtgcgcaaagaaactaccctgacttttacttctgggcagatggggtggagggagtaccccttcaattcagccttacattttcctgtttgaccaaagattgcccaagtctggcgttcctcccttgcaggaggtggaggttgttggtggaggaggagccatctttgtttgctggtgcccggaatggtctcctcttcttctttccctatccctccaaactgtcttgtaagatgagacctggggaggaaacttctttttggaaattggtgtagaagaggtgtgtggggctacctctatgctcctctgcaaggggcctttggcgatgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttgggaggctaaggtgggcggatc

SEQ ID NO: 6107 - DNA, 6931 bp, Homo sapiens
cggccccgccccgccgcggctgcagcagcagcgccgcggccggaggagctaccgccgccaccgccgccaccgcctcctgggactcggaacgcagcgctcggagccatggcctcggcccccgcggaggcggagacccgacagaggctgctacgcaccgtcaagaaggaggtgaagcagatcatggaggaggctgtgacacgcaagtttgtccacgaagacagcagccacatcatctccttctgtgcggctgtggaggcctgcgttctgcacgggcttcggcggcgggcggctggcttcctacgcagcaataagattgcagccctctttatgaaagtgggcaagaacttcccgccggctgaggatctgagccgcaaggtgcaagacctggagcagctgatcgagagcgcgagaaaccagattcaaggcctccaggagaatgtgcggaagctgccgaagctgcccaacttgtccccacttgccatcaagcatctgtggattcgcacagccttgtttgagaaggtcctggacaaaattgtgcattaccttgtggaaaacagcagtaaatactatgagaaggaagctctcctgatggaccctgtggacggccccatccttgcatctttgttggtggggccctgtgccctagagtacaccaagatgaagactgcagatcacttctggaccgatccctcggctgacgaacttgtccagaggcaccgcatccacagctcccacgtgcggcaggactcgcccaccaagcgtcctgccctctgtatccagaagaggcattccagtggcagcatggatgaccggccatccctctctgcccgcgactacgtggagtccctgcatcagaactcccgtgccacccttctctatggcaaaaacaacgttcttgttcagccgggtctcactccaggttatagaggaaaaggtctctctggctccagattgccaatccattcatccatttatgcactcacccatgcacacatccacccgcccaacactcattcatccatccatctatatttacacgcacccatccttacatccatccatccacccattgttatatccatccatccacccattgtcacaaccatccatccatccacccatctttacatccatctatccaaccatctttacattcacccatccacccatctttacattcacccatccacccatctttacatctatccatccatccatccatccatccatccctccatctatccatccatccatttttctgattatgtgttcttaaatcaaacgggccagacctatgtccacagcaactccagcaccatggccagacctgaggacgacatggaggctgtgccagggtacctgtccctgcaccagacggctgacgtcatgaccttgaagtggacacccaaccagctgatgaacgggtctgtgggggacctggactatgagaagagcgtctactgggactatgccatgaccatccgcttggaggagattgtctacctgcactgccaccagcaagttgacagcggcgggacagtggtattggtcagccaggacgggatccagaggccgcccttccgcttccccaagggcgggcacctcctgcagttcctctcgtgcctggagaatgggctgctcccacatgggcagttggacccgccactgtggtcccagaggggtaagggcaaagtgtttcctaaactgcgcaagcgaagccctcagggttctgccgagtccacatcttcagacaaagatgatgatgaggccacggattatgtgttcaggatcatctaccctggcatgcagtcggaattcgtgccccaggatctgatggacgtctctgtaagcaacctcccatccctgtggcagcccagtccccggaagtcctcctgttcatcctgttcacagagtggctcggctgatggtagctcgaccaatggctgcaaccatgagagggctcccctgaaacttctctgtgacaatatgaagtaccagatcctctccagagccttctatggatggctggcctactgcagacacctgtccaccgtgagaacccacctatcagccctggtcaatcacatgatcgtgtctccagacttgccctgcgatgctggacagggactgacagccaggatctgggagcagtaccttcacgacagcacaagttacgaggagcaggagctgctgcgcctcatctactacgggggcatccagcctgagatccgcaaggccgtgtggcccttcctcctgggccactaccagttcgggatgacggaaacagaaaggaaagagtcctcccagagctgcagttcgggccgccagaacatccgcctgcacagcgactccagcagcagcacacaggtgtttgagtctgtggatgaggtggagcaggtggaggctgaaggcagattggaggagaaacagcccaagatccccaatgggaacctagtgaacggcacttgttccccagactcgggtcatccttcctcccataacttctcctcgggcctctcagagcactcagagcccagtctgagcacagaagacagtgtcttggacgcccagcggaacacccccacggtgctgcgacctagggatggcagcgtggatgacaggcagagcagcgaggccaccacatctcaggatgaggctccccgggaggagctggccgtgcaggacagcctggagagtgacctcctggccaacgagagcatggacgagttcatgtccatcacgggcagcctggacatggccctgcctgaaaaggacgatgttgtgatggagggctggaggagcagcgagacagagaaacatggccaggcggacagtgaggacaacctctcggaggagcctgagatggaaagtctcttccctgccctggcttctctggctgtgactacttctgccaacgaggtgtcccctgtgtcttccagcggcgtcacctactctccagagctgctggatctgtacacggtgaacctgcaccgcatcgagaaggatgtgcagaggtgcgaccgcaactactggtacttcacgcccgccaacttggagaagctgcgtaacatcatgtgcagctacatctggcagcacattgagatcggctatgtccagggcatgtgtgatcttctggctccactgctggtcattctggatgatgaggcccttgccttcagctgcttcacggagctcatgaagaggatgaaccagaacttcccccacggaggcgccatggacacgcactttgcaaacatgagatcgttgatccagatcctggactcagagctgtttgagctgatgcatcagaacggggactatactcacttctacttctgctaccgctggttcctgctggatttcaagcgagaactcgtctatgatgacgtcttcttggtctgggagaccatctgggcagccaaacacgtctcctctgcgcactacgtcctgttcattgcgctggctctggtggaagtctaccgtgacatcattttggagaacaacatggatttcacagacatcatcaaattctttaatgaaatggctgagcgacacaacaccaagcaagtcctgaagctggcgcgggacctcgtgtacaaggtgcagactctgattgagaacaagtgaggggcacctcaccccggcagcctcagccaagctgcccctgccccgctcctctgcttacttttcctcctggctggatgggcaccccgggagcggggtcctggtgtctgttcacaagcgtggagttcagtgcgcaaagaaactaccctgacttttacttctgggcagatggggtggagggagtaccccttcaattcagccttacattttcctgtttgaccaaagattgcccaagtctggcgttcctcccttgcaggaggtggaggttgttggtggaggaggagccatctttgtttgctggtgcccggaatggtctcctcttcttctttccctatccctccaaactgtcttgtaagatgagacctggggaggaaacttctttttggaaattggtgtagaagaggtgtgtggggctacctctatgctcctctgcaaggggcctttggcgatgttctggacatggctgaagattgacttagagattgaccctccacctcgacattactgacatttggggccaggtgattctttttgaggggactgtcccctgcattgtaggatgctgagcagcatcccgggcctcaccagatgccagtagtgccatcccccaaccatacccctggttgtgacagcccccaaaaatgtctctagacattgcgaaatgttccctgcagggcaaaattgcccccatttgagaaccactggcttggagaagggactacaaatgtacttcctcccccattcttttgacgctaagccaccctggtcctgacgcctcccctcacttagaaaaggcatacaggaggccgggcatggtggctcacacctgtaatcccagcactttgggaggctaaggtgggcggatcacaaggtcaggagttttgagaccagcctggccaacatggtgaaaccccatctctactaaaaatacaaaaattagctgggtgtggtggcgggtgcctgtaatcccagctacttgggaggctgaggcaggagaatcacttgaacctgggaggtggaggttgcagtgagttgagatcacgccactgcactccagcccgggcgacagttcaagactccatctcaaaaaaaaaaagaaaaggcacacaagagtccctcacacatctctcttggagtctgggattccatctgttgtattttctccttttttctcctctgtctgatgccagaagatacttgttttcttcttttcaagaaaagtatctccccacataggcggtggacccaaaaagtgtaggcatgagacggtcagagctctttggggtcctgctcagagtcccccaggcagggcagagtctgtatcctgctgccatcttgcaagggaaaaccgcctctccttccaagtattgggtcttggaaaggtgtgtgtttggtgaaagccacttaatggtggtggggtgcagcttttctctaagtgcagttactcactcaggacaaaggaggaaaaggaaggcagaggtcagccagggtagagggtgatgtctgttttccttgggaaacatctgctgatgaactgggtccagggccgtgctaggtctgggaacaatcctctccaggtcttcacacagagtatcaccaatccacaaacagacccgaagtgaactagtttactctgcctacctgtcctttcaatagagcagtctttcccgctcttctgttctgagaatgcacccggaatgggggaaacccagcaagcagcagagagaaaggctcttcccgggagacctgccgcctctagggtggtcagagaatagcagctgggattttggagagggagaggataggtaaagcagcgtattgaagcatttgcggaggggtgtattagtcctcccaccctgagcacaccaggacggggatgcatccttgccttgtgtgcttgtaaaggcttctttcccttggtatagcaacttcaactgcacctgaacctccaacctctgcccagcctctggtgcagggtggatagaggtctagccagcccttacttcctgaagagagctctgtgggaaactcgaggctacagtagcttcccggctcccagctcctaccctacccccaccaaagcagaaacgggagacggcaacgttctggctgccattagacttacgtctccctcccctacgtcccctagcttcccaagacaggaagaaatgtgcaaaaggcccctccggagaaaactattttgccgttcagctgttctttacagaggatgttattttagtgagacccaggtcctagaccttctgattcctatttatttttttaacagactagtctcaaagtacagcacaaaatctcttctctgccttctcttgtgatgttccagagagcatctgtggttgtgatttggaataagtcatatttatttggtttactgtgcctattcagatctctgtatgttgtgtgtgtttctgtgtcctggaattggatgcgtgggactcgttctgtccgcggagtgcactctttttttcagtgtggcccacatatcttgtaaatgtttgctgaagagttgtgtctatatatagagaaaatatatataaacagagaaatatgtgaatctgtttttttttgtctttttttttttaatttgaaagaaaaaaatgcttgcttctgaggactgtgtcctcccactcacaccccagtgaccctatatggggtcagatttttgtaatagctgcctggccttttcccagaaaaggtgaatcacttctgacttcttgtattagctggctcttaccacaagtaatgctgcattacaaatgacccaaaaagtagtggtttaaaacagccatgtatttacctcataattctgtgggtcagcatcccaggctaggttcagctaggaggttcttctgttctcagacttcttcatgtgtctgtggtcagctgatgtccagataggcaactctgcttctgatggttgtctggctgttgactagggcagtgggggaaactggattccgtatcttgcatcctccagcaggctagcttaggcttgtttacatggctatgatagcagatcccagaaggtaagcagaaacacacactgtctcttggtctcagcttctctggcataaagtcatttctgccacattctgttggtcagagtaagtcacatgactcagcccagcttcatagggtagggaaatagactgtacttcctgatgagaatctttggaaagtgacactgaaaaggagcatgggccaggcacagtggcttacccctgtaatcccagcactttgggaggccaaagcaggaggatcacttgaggccaagagttcaagatca

SEQ ID NO: 6108 - DNA, 4541 bp, Homo sapiens
agtggagggcggtgggggcggggcaagcgcggaggaccagggaccggctccggaccgcgcagttagcgccgcctggcctgggccggacccggtcagggttctcaagctgtcgtccctatggggctgtgttttccttgtcccggggagtccgcgcctcccacgccggacctggaagagaaaagagcaaagcttgcagaggctgcagagagaagacaaaaagaggctgcatctcggggaattttagatgttcaatctgtgcaagaaaagagaaagaaaaaggaaaaaatagaaaaacaaattgctacatccgggcccccaccagaaggtggacttaggtggacagtttcataaagcataacatgagtagaagaatctactgccaataactgtttattatctgcaatcaagtgggcttcatcaatttaatttcttctctttgagtaaatgaagattcagactttgtaatattattgcccttaagtgcaatgctaaaaaaacgttgattttcaagcttagagaatggctagacttttcattaaatactgattttcctacatttgctcttctgcagttagtgggtgatttgctatttttcttagtagttaaaaaatggaactaaatagtgaatatacatacactgcatgtaaacattctgcatatacctctaagattaaaattcgcagttgtcttttcatcctttataaaatgatctaactacttatatttgtgctgcatcgcgttacatctgtttttatttcactatgaagatgtttgattaaacttatggacttagtgcctttaaactgatcatcagggagaatcttgaaaaaatcatttgaagggctgatgtgaaggagcactgtaaatttttataacttagtaatgagtattcttaggcagatgtaaaattttttccaatttatttttatttatgtagcttataaaattaacataccctgttttactttatgataaaggattttttgtttgctgaatttaaaattatatattagtgataccatcagagggcagtgatgttctattgtatattaaattcagctctgtaaggatctttgtagtaattgaatgagttaaactaataatctggatgggttataatgagtagtaatatatttgtccatatttcataagtagtgttaatcttgtgtacttattagagaacgatcataagatttatacagatgtgaaactgcgaaggcaagtatgaatgtatgaaaaaaacatgtaggtactgtacttacaaaaggtctacttcagatataaaaatattaggtaattctatacaatgcatagtcataaaccttaacatttttgttcattagaaacatgaattttatagcattttttgtttctcctatataatacactgaaataaaagaatttgtgttagctattaaggctgatagctcttttaaatggcaaggccacatgttgagccctaaattaaaatttgcagatattaagtgctaatagaaattttaagttaaatcgaccaagttcacttgctttacacaaaggaaactgagccactatcttcatctacccctccaacaaaaattatgttatactgcagtgtattgtacatgttaatttttaaaagtttgaactattatataatacaggtctcttgacttctcatggaaaaattattttttctattatggtgtgaaatattgtgtgaatatctaggcaaaacataacaatttggctcaattttcttctttagaggattcgtgctgtttttgttcataaagggtagtgaaatcattgaactatattttagaatgaaaatttttgattttattaaaatgattttttcaaggcagaaagtaaaaggaatgattgatagcggagtgcatatagagctagagcatatcatccttgaactctgcaaatcctttcttccattttaatatagcaagaacaattttgtctttactacatcttaaagaattagaacttgggttggtgtaagtgacttacttccagggaatcatgccctatttctaccagcaggtcatacccaaatgtcacactatctattgttaaccatgaatgatattcagatctattacttttcgtgaaaagtggaacatgttacttccaaccatggcctgtcaccgtgagtgtgatcagctttctccaaaaccacatgggtcgcaggagctaaggggtggtacccaaatgttaggaacagtgttaggaaagggcaagggaaaagaagtgactggatgtcttatgagaaaccggtaaatgactaaaaaaaaaagcaaatgactaaaaacatgactaaaaaattatatatatatataatatatatattatatatgtgtgtatatatatacacataatatctgcaaattctaatttatatatgtgtgtgtatatacacacacacacatgcacatacacacatacgtccagacatctccctcataaaataaccatcagtttctatgaaaaccttaagtggaagccaatttcccatagtaaataatttaggagaaaattataatgcttaaaatgttgctcaaacccctgacctattactaaactataattggaacagtaaaatgcatatatgtaactatcatatcatgatttaaaattgcttaaaccattgctgcttaatactaatcaaacttaacggctgctaacaaaagttgtgaattattacacggcctctttgtaacgtgctgcatgttttttaaaacatctctgtgtttctgtttgttccactgctggtatttggaatgtaatttaacagttctcacacatggtttggttataaattctgtattgccttttagggatataaatatacatttttttctatgtaaaaattagctttagctgtctctttaacaaaattttatctttactacatcctaaatacttagaacctgagttggtggttagggaaacctcaggaacattttaatcacattgggattcagaagagcaacagaaccaaaggttgtttggtgtgttcatacaatccctggatttataggtggattttctataaaggaaaaatgatgtaattagtatcctgttttttcctaaagaaataatactatcataaaaattctgtctatcctttgtaccccaggaaaatggacatgaactttgaattttccctttctccaaatgtttgactttttattttcactgataagcattatgctatgttcttagaagacaaaagcagctcttgccagttttgaataatttctgcatgaatagaccagtaagaggtaagtagccatgactgcctatatgtgttgagacataaggtatatttctttaacatctccaagcaagcatttcaaattctcttaactactaaacatgctctaagctaattcaaatatagtattgtggcttttttcttcaattttctcaaaagctacagacacaaggcatttgtatgtataacagactttgatgaagttttggttccagtaactcaaaacactaagtttcccatttgatatggctttttattgttctagtctccctcttctagttatgcttcatcttgcaaatattgactttgaatgtgataactattgcctacaaattaagtattcatacattactcctgtggatatcatacttttttgttattatatcctgaattgcattggctttttttggttttgttttgttttttgagatggagtttcactcttgttgcccaggttggagtgcaatggcacaatctcagctcaccgcaacctctgcctcccaggttcaagtgattctcctgcctcagcctccctagtagctgggattgcaggcatgtgccaccacgcctgactaattttgtgtttttagtagagacagggtttctccacgttggtcaggctggtctcgaactcctgacctcaggtgatccctgccgccttggcctcccaaagtgctgggattacaggcatgagccaccgcgcccggcctgcattggctatatttataataccaaatttgtgttgagttttgagttaatgtcttctagttatcaaaacaggtttgatccattctttgcaagtacctctaacttatctcaagtggaactaattagttttgcacacagattggtgctctctaggctatttccctgaaatttatcttgttacataagtcagatatcaaggagttatgctaaactccttttcctatcaaactcctaaaatgcccttttctctgtctatatttcttagacatagttacattataaatgtaacagatatatttaaagtaggttaataccaagtgtctcaggtagaaaattctcagaggttccacaaaaacttctggaactaataaatgactttagtaatcttgcagaatgaaaagtatatgaaagtcaattctatgtttatatgcaagcaatgaaaaatctgtaattgaaagtgggaaaatttaaattacaatatcaacaaataaaatatttaggaaaaataaaactgtagacattaaaaatgacaaaacattgccaataaattaagatctaaatg

SEQ ID NO: 6109 - DNA, 2572 bp, Homo sapiens
ggactcgagcgctccgattggagttagggcctgcttgtctgcgtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataa

SEQ ID NO: 6110 - DNA, 674 bp, Homo sapiens
gtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccaggtgagtggcactccttcccctcttttggtgtcacattcaagagacgcagcccaggctttgccctgactgactgtgtgaccctgcgcgagtccctgcttctctctcggttgtgggctcctcagatatttaatgggggtggtgtttctttgccctgttcctggagcaaggtggtagcgttgtgatggtggggagctttagatggggaaactgaggtccagaggggcgtgacatacctacctactctgcatgaagctgttgtcgccaggg

SEQ ID NO: 6111 - DNA, 2422 bp, Homo sapiens
agtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataa

SEQ ID NO: 6112 - DNA, 2441 bp, Homo sapiens
ctgaggcctgcgcgaccccgccagagatggggctgagtcccaatttagacaggcagaccatggcagagttctcccagaaacgggggaagcggcgtagcgacgaagggctgggcagcatggtggacttcctcctggccaatgcccgcctggtgctgggcgtgggcggggctgctgtgctgggcattgccaccctggccgtgaagcggttcattgacagggccactagcccgcgggatgaggatgacaccaaggcagacagctggaaggaactgagcctgctcaaggccacaccacacctgcagccccggcctccacctgctgcccttagccagccagtgttgcccttggccccctcgtcgtctgccccagaagggcctgcagaaactgatcctgaggtgacaccacagctcagctccccagcaccgctgtgtctgacactgcaggagaggctgctggccttcgagcgggaccgtgtgaccatcccagcagcccaggtggctttggccaaacagctggctggcgacatcgccctggagctgcaggcctactttcggagcaagttcccggaactgccctttggggcattcgtgcctggggggccgctctacgacgggctgcaggcgggggctgcggaccatgtgcgtctcctggtgccactggtgctggagccgggcctgtggagcctggtgccgggcgtggacactgtggcgagggaccctcgctgctgggccgtgcgcaggacgcagcttgagttctgcccccgtgggagcagcccctgggaccgcttcctggtcgggggctacctctcctcccgcgtcctgctggagctactccgcaaggcgctggctgcttctgtcaactggccggccattggcagccttctcgggtgcctgatccggcccagcatggcctcggaggagctgctgctcgaggtgcagcacgaacgcctggagctcactgtggctgtgcttgtggcagtccctggggtcgatgctgacgaccgcctcctcttggcctggcccctggaggggctggcggggaacctctggctgcaggacctgtatccagtggaggctgctaggctgcgagccctggacgaccatgacgctgggactcgccggcggctgctgctgctgctgtgtgctgtctgccgtggttgctcggctctggggcagctaggccggggtcacctgacccaggtggtcctgcgtctgggggaggacaacgtggattggacggaggaggccttgggtgagcgcttcctgcaagccctggagctgctcatcggcagcctggagcaggccagcctgccctgccacttcaaccccagcgtgaacctcttcagcagcttgcgtgaggaggagattgacgacattggctatgcgctatacagtggcctacaggagcccgaggggctgctctaggtgggtggaaacgggtggttgccatgttttctaatgctggggagctgcacccacctcccttccagggatttgaatagtggtttttctctagctttttgccagaacaaaggagggtacattacttaaacccagggcatcaggatgtgcttgggctatggtggccataaaccctgagcccagagagcttgggtcactgtcacctgagtgcagctgggctgcctcaggcagcttggagtgccagccattcctgcaagcaccgtttcagctcttggggccaaccccaggacctttggctctgtccatcaccagcaaccaatccaccaacagaatgtggtttctgccatcctgggcagaagctgaaggccagcttcacatttctgctgagagaaggtgacttaacgccttttccggccctagctccaggcgttttgaggcgtctggtgcctgatggtaggtatggtgtgtttgttctgtcccccaggggctggagtcacctggtgcccctgaaggacagatttttggctgttaaaggatggcattttcctgctgtcttctgtgcgtttagttttcttgctgagcgggagctcagtatgacttgccacccacctgatacctcagggcaaggccctttttccctccagccaggtgagtgttttcttcaggcagctgagggtcctgggggagctgaggctctgtgctgcacccccagcccacagctggggcatctcactggagctgttccaggccccactggagagcagaggacctgatcccccactagagaggtccggtgtgcacagccggcctcccagtgtgccaaaatgaactgctctcagctgatggctgtattctgactttgaagcctgttaagaggtagcaagggggctagaggagggagattccacctcccctcccaagtgaccctcctcctgcctctggtatccttccttttgaaacgaagctcagcttcgaagatgtgaacaagaataaaaggaaaaaattctaatgtatatataa

SEQ ID NO: 6113 - DNA, 5625 bp, Homo sapiens
gaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaagcttgcatctctgaccaaatttcacataaaacattggaaggaggctgggtgcggtggctcatgcttgtaatcccagcactgggaagctaaggcgggtggatcacttgaggtcaggagttcgagaccagcctggccaacatggtgaaaccccgtctccacgaaaaagataaaaataagctgggcgtggtggcaggcgcctataatcccagctactcgggaggctgaggcaggagaataacttaaacccgggaggcggaggttacagtgagctgagatcgtgccactgcactccagcctgggtgacagagtgagaccctatttcaaaaaaataaaaattggaagaagagcttaaaaaagataagattttaaagagtcccaagttatttaagttgagtgtaattgtcatttaaggaaggcaaatgagtttatcatccttcttaaagagcatctcttttaactgttggacaaaaccataactttgtcattttacaaggaagaacctcttaagaagtcctcagaaccagaagcaatgtgaactctcagcgctggtcctggtgggtttgctgaccatgactgggcaagccgttctttttgctgccatcttcctcatcataaagtgtggaacataggcaattgctttgagattcttggatagaagaggacaacattctgcacctgcccccttttttaaatctttggggaaagatgagtaactttccccactactctgccttcctgttcagtaactcttacttttgcctgaagtaacagcatcttctacttctccatctagagatttttgtgtgtgtgccatcaaggttagcaaactttatacgtagcctaacacttaaaaaatgcactcattatcttaaacctaataaattccagagtttattttggttctcctctgttgcccttcctaaaaaatgagctgaagatgacagtatttttctttacatgcttggttatgacttttaaagttttatttaaataaatgttgaagctcaagtttaaagaagcgttgcagaggcccacggtctcctgggtcccggccacctgtccatattccacatttgctgactgtgctccctgcactccactcaagttgagagttcaaatagtcttgaaggggaatcagcttcaggatggaaggacccaggagaggccccgaggtgggagggttctgtaaatacagactactgcgagtgtccagagctctctgccatgatacttccttgggactgacttggctgagaacgtgttctgtcagaggatttgttagaactctgcccttttgtctgaaactcaaggccaaggagaatgataggagacttaggacagagctgacccttgcaccaggctgggaggctgcagcccttttagatgccacttactgtaagtggccagaataccagagaggtgggttccatggtcaaatgcacagtaggtgtttacctttacatttggatcaccttgtagtctttaaattcttggtccctgaggccaagtccacaacttgccttctagtcacttgcctgcccgcagtggtggtggatgtgttagctggtagatttggaatcagtcaccagtctttctgtactgtcttggttagctctatataagtaggggcagcttagccctgaggcccagagacctgctgtcctttttctccttgagggaggaaataaaactgcggaatacaatgtccttccatagcatgggaagaagaaaataaacatctcctttccaaca

SEQ ID NO: 6114 - DNA, 2269 bp, Homo sapiens
ctccatctcaaaacaaacaaacaaacaaacaaacaaacaccctgcaatatcaatccaagagatcctggaatgcctcttgccctgtgaaacctggcagagccctgaggtttgggtcagtgccccctgccgtgggtctctggcctacaaaggcaccatggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtca

SEQ ID NO: 6115 - DNA, 3797 bp, Homo sapiens
ccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacagatacattctgcccgccccggcccaagccagtggccaggaagggccaggtagacttgaagaagtcacgactccgcatgtccctgcaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaa

SEQ ID NO: 6116 - DNA, 1379 bp, Homo sapiens
agaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgactt

SEQ ID NO: 6117 - DNA, 3838 bp, Homo sapiens
gctcccttcagccccttcgcagctccgtgcgcaaggtcgtgtcccggaagtgaaggggccatgttgatgggtgacccggggagaggtacccggccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcagatgagcaatggcaggcgctggtgagcgcaaaggcaagaaggatgacaatggcattggcacggccattgactttgtgctctccaatgcccggctggtgctgggggtgggtggagcggccatgctgggcatcgccacgctggcagttaagcggatgtacgatcgggcgatcagtgcccctaccagccccacccgcctgagccattcggggaaaaggagctgggaagaacccaactggatgggctccccacgactgctgaacagggacatgaagacgggcctgagccggtccttgcagacccttcccacagactcctccaccttcgacacaggagaaacttcttacttactaccggaaccgggcagccatccctgctggagagcaggctcgggccaagcaagctgctgtggacatatgtgccgagctccggagcttcctgcgggccaagttgcctgacatgccgcttcgggacatgtacttgagtggcagcctctacgatgacctgcaggtggtgacagctgaccacatccaactcattgtgccccttgtgctggagcagaacctgtggtcatgtattcctggtgaagacaccatcatgaatgtccctggcttcttcctggtgcgtcgtgagaatccagagtactttcctcgtgggagcagttactgggaccgctgtgtagtagggggctacctctctccaaagacagtcgcagatacatttgagaaggtagtggctggctccatcaattggccagccatagggtccctcttggactatgtgatccgcccggccccacccccagaagccctcacactggaggtgcagtatgagcgtgacaaacatctcttcattgacttcctgccatcagtgaccctcggtgacacagtcttggtggccaaaccacaccggctagcccagtatgacaacctgtggcggctgagcctgcgtcccgcggagacggcacgcctgcgggctctggaccaggctgactcgggctgccgatctctgtgcctcaagatcctcaaggccatatgcaagtccaccccggctctgggccacctcactgccagccagctaaccaatgtcatcctccacttggcccaggaggaggctgactggtctccggatatgctggccgaccgtttcctgcaggccttgaggggacttatcagctacttagaggctggagtcctgcccagtgccctaaaccccaaggtgaacttatttgcagagctcacccctgaagaaatagacgaattaggatacactctgtattgctcattgtctgagccagaggtgctgctgcagacgtagggcaggtgaaggccaaagcgggtgttggtggtcaggccctggattctccgttagatacacttggctacctagttggtgcctcacagggttcctgctgcctggtgtcttgctgatcatcaccctggtcacttcatgctgattagaatgacatctctttcgtctcctattttgttacccaactcttcctatttttgttaccaatcactgtgctctctgccgccccctggctccaggctaatttttctggaatgaattgagaaggtggcgtgctggcctgagctgatggaccacttggtgttttgcgttttggcccatgtttgctgcctctatctggtctgccttgcccgtttgcctgttcctattcagtgtcttttctattttttcctctctcgttcatgccttctgttttgctcttgtccctggagcatatctgcctaattaagatgttgccttttagttgaatgccactgaagagctgtgatagcatgtttcaaagctgaactctacagagcgagtgctgagacagtatttagggtttctgggagtgaggctggtagaagagttggcctttgaccacggttcctggagtagaagtccatcctccccccaacctcctgacccattcataaatgctgagaatgtctctcatgggaacactgttaatgacccacacaggataagctgaatgcaaagttatttgcaggttgaatttcttggtggctattagcagaagtgcagagtagggaaccagagctggttaagggcctagtgaagggtttgtgtgcccagtgtctgctcgtcatctgtggctgcaggggtcagacagacaaggatggggactgccagggcaccacttcatcatgaatgctggttttcacaccttttccttattttattgccaatcaggacaaggccttgaaggaacgcagccttagacatcaggtgaggatgatggaggtagacagtcgactgaatgtcagctggaaaatccagtcactagttggggtttggtggccatgttttctacccagacaggccctgcttttctaggatgtggccttagagcaagaacagacccaacagccagcccttcatcctccagcgtctgccataggaatgtgagaggggtgtttgctgagcgctccgggcacggccagagggcaagtgagcatgcacggacctcttccccctgtcctgtttctcacccagcacctggggagatcggtgctaccaaggaagagagcacacagataagacagaggggaggaggtgggcatttcctacattcctccttgtttgccgctgctgagattgcagtatttattgcaatgtaaatgtatcctgaaggtggggaggaatgtttaatctaccatgtccgtgtgtcatcttggtttgtgtttttccctgtttgtagcaagactctgatgataattctgtttctcatctgcccattcagtattttgttttccttccgtcaagttgtcttattttttcaatgactacctctccatcattgaggttctggtgaagctctctgcagctgtctcattccttcccaacgatagtaacaggaaatgactctttagcatcgatacctcaacatcaatttagggtagagattcctgcccctcttttgtcacagattaggaaattgagaactagggttaaccttgactatatttagaggtctttttgcctcttttccccttaacaaggatttcttatggtggtttcagtttcatttgcataaaggtattgagagggaacaaaaaacataaagctgagaatcttgagagagctcatctaccctgtctgttggtcagactcaaatgagagttaaaaaaaaaaaaaaaaatctgtatgcctgagtaccatcctggatgaatctagaaggtatggggtagagcttgacagggttcctgtgtacccactgggtatccgttagaggtaagggagaggagaggattgatagagtgttgcaaaagtatagattattcattgagataaaggatttggtttccctgccatgagtattaaaaaaatttaagttttcccaa

SEQ ID NO: 6118 - DNA, 744 bp, Homo sapiens
ccagaggcgagtcctgcggagtggtagcgcgcacggcctgcggtgtgacacccagcccctgccagtcccccatggccccgtggagccgagaggcggtgctgagtctctatcgggctctgttgcgccagggccgacagcttcgctacactgatcgagacttctactttgcctccatccgccgtgaattccgaaaaaatcagaagctagaggacgctgaggcccgggagaggcagctggagaagggcctggtctttctcaacggcaaattggggaggatcatttaggatcctccaagggaaagaggacaaaggtgccttctgtagacactcctgctctcttccatccccatcttacagatgtattaagaagcctcaggacacgggatattatagaggagagtggcagcatgctgagtggtattccgatctgaatcacactgtcatcctttatccggctcaggcccagggttctaactccacaggaatgggcttatctggggactgctgctgctgcagtcaggaagactccactgtagtcgggagcagcactggcctgagcactgcactggaggccagcctcttcgctgtggtgcccaagtacttctttcagatgagcaatggcaggcgctggtgagcgcaaaggcaagaaggatgacaatggcattggcacggccattgactttgtgctctccaatgcccggctggtgctgggggtgggtggagcggccatgctgggcatcgccac

SEQ ID NO: 6119 - DNA, 3055 bp, Homo sapiens
aagaggcgccaccgtctccaaggagtggtccggggcaccggtttcaaagtcgcagggcgggccgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggttgcacagtgaattaaaagatgctgttgaaaaaaaattggaggcctttcccctgggcacagaggtaggaactgacatatatgcagatgatgaaacagtcagaaaccttcaagaacaattgcagctagccaatcaagaaaaaactcaggctgtggaactctggcagactgtttctcaggagttggacagactacacaagctttaccaggaacatatgactgaggcccagattcatgtatttgaaagtcaaaaacaaaaggatcagctatttgattttcaacaactgaccaaacaacttcatgttactaatgagaacatggaagtgactaaccaacagtttctgaaaacagtaactgaacaaagtgtgataatcgaacaactccgaaaaaaacttaggcaagccaaattagagctgagagttgctgtagcaaaagtggaagagttaactaatgtgactgaagatctgcagggacagatgaaaaagaaggagaaggatgtggtgtctgcccatggaagagaggaagcatcagataggcgtttacagcagttacagtctagtataaaacaattagaaataagattatgtgtgacaatccaagaagccaaccaattaagaaccgaaaatacacatctggaaaaacagaccagagagctacaagcaaagtgcaatgaattagaaaatgagagatatgaggctattgtaagagccagaaatagcatgcaactcttagaagaagctaaccttcaaaaaagtcaggctctacttgaggagaagcaaaaagaagaagacatagagaaaatgaaagagacagtttctcggtttgtacaagatgctaccataagaaccaagaaagaagttgcaaacaccaaaaaacaatgtaatatacaaatttctcgattaacagaagaactttcagcccttcaaatggagtgtgctgaaaaacaaggccaaattgaacgagtcattaaggaaaaaaaagcagtggaagaagaactagaaaagatttaccgtgaaggcagaggaaatgagagtgattacagaaaactggaagaaatgcaccaaagattcctggtttcagagcgttcaaaagatgatcttcagctaagacttacgagagcagaaaatagaataaaacaacttgaaactgactcctcagaagaaatatcacgttaccaagaaatgattcagaaacttcaaaatgtattggagtctgagagagagaactgtgggcttgtcagtgaacaaaggctaaaacttcagcaagaaaataaacagttacggaaagagactgagagtttaaggaagattgccctggaggctcaaaaaaaagccaaagtaaagatcagtacaatggaacatgaattttcaataaaggaacgtggatttgaagttcaattgagagagatggaagacagtaatagaaattccattgttgaactgaggcatctcctagcgactcaacagaaggcagccaataggtggaaagaagaaacgaagaaacttactgaaagtgcagaaattagaatcaataatctaaagagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaagaactcattgccttcatcaatgtgtctgttttttaattcctcctttttcccttgaaaggacataataattttcaaactatgcaaatttctctttcataagaaagagtttttaagaaaattctagaatttaatatttcagtttccaagatttgagaattttacatctaattgttacttctaactcatttttaaagttcctaagtatccattttattatgaactcataaatgtaataaattgtgcactttctaaaa

SEQ ID NO: 6120 - DNA, 1910 bp, Homo sapiens
gcaagaggcgccaccgtctccaaggagtggtccggggcaccggtttcaaagtcgcagggcgggccgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggttgcacagtgaattaaaagatgctgttgaaaaaaaattggaggcctttcccctgggcacagaggtaggaactgacatatatgcagatgatgaaacagtcagaaaccttcaagaacaattgcagctagccaatcaagaaaaaactcaggctgtggaactctggcagactgtttctcaggagttggacagactacacaagctttaccaggaacatatgactgaggcccagattcatgtatttgaaagtcaaaaacaaaaggatcagctatttgattttcaacaactgaccaaacaacttcatgttactaatgagaacatggaagtgactaaccaacagtttctgaaaacagtaactgaacaaagtgtgataatcgaacaactccgaaaaaaacttaggagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctgttttgagggttattggaaaacagagcagtgaccacttcctgtaagtaaagaaaatataatcctatattgagcttcagtggagaataaaccagctgagaagaactcattgccttcatcaatgtgtctgttttttaattcctcctttttcccttgaaaggacataataattttcaaactatgcaaatttctctttcataagaaagagtttttaagaaaattctagaatttaatatttcagtttccaagatttgagaattttacatctaattgttacttctaactcatttttaaagttcctaagtatccattttattatgaactcataaatgtaataaattgtgcactttct

SEQ ID NO: 6121 - DNA, 966 bp, Homo sapiens
gagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccagaaacaggtgggtgagatgaaattacaacttgaaaatgtcatcaaggaaaatgaaaggagtgagctgagtcgacagaaacttcatacccaagagctgctttctcagctggaaatggcaaatgaaaaggtagctgagaatgaaaagctaattctagagcatcaagaaaaagccaacagacttcaaaggcgtctaagtcaggcagaagagagagctgcttcagcttcccagcagctcagtgtgattacagtgcagagaagaaaagcagcctccctgatgaatctggaaaatatttaaaaatattcatagttcactcacagaactttagagttgggaaagcagttggactagaagtgtattgaaatggtaaagcctgcaaagtataatagttaaggcttgtgttatttcgcgtaagcattgttgttctg

SEQ ID NO: 6122 - DNA, 1696 bp, Homo sapiens
cgagtggacttccgctgctggcctggggcttcccagccgtcttggcgttgtcctctccaacccccgccgctccgcgtagaacgccgctctcaggctgccgtcaagctcccgcggcactctcctaggtggcccgacgagacccagagtgacccgcgggacgcctgtatcgaccgcgtcctcttcccaccagcgtgggattcggttgaacgtggagtccccagcaatcttcagtctctcaccagggccagggactcgtctggggcgcgggggaaagaagcgtggcggggctgtagatgccgcgtgagtaggatgcagattgcaccgctggagcgcttgacaaccaaccgagcgttggcttagttttgttttcccgcacagcaagctctctgtctttcagaggaaggtaaaggtggtgaaagctctaaactaaaattgtatcgaaatggctgcagaaatcgactttctgagagagcaaaatcgaagactaaatgaagattttaggcggtatcaaatggaaagtttttccaaatattcatctgtacagaaagctgtctgccaaggagaaggagacgacacatttgaaaacctagtatttgaccaaagctttttagctcctcttgttactgagtatgataaacacctaggagaactaaatgggcagctgaaatattaccaggcataacgaggaccttggaaaagttcacctttcaaaccaaatttatagttagaatttgctattctgatctcctagaccaagcttccttgatcttctcggttgaaagagagagaaaaaggctggcagaactgcctgttccacctggcccttgcgaaagtgtactccaggataagcttctctcctttagcttaggaagcacaatcaagactaatacacaatcatgaattagttaccgttttaagtgagattttgcatgcttttacatgtaaattcagggttttgtgtgtgtgtgtgtgtgtgtgtgtgtgtgtgcgcgcgcgcacactctccatttgctcattcacacttactgagagttgactacttattttttgctattttgcttttactcatattttcgccaactttaaatgctttcttttcttttgaaatcctaacatctttttactccttcagagaacgttaatcagaccttcatttaattccctttctggtgtgcattttattctgccttgtattttagttaggattttttttaaccatctttcctactatttttcaatgagcatgtctgtttaccttagcgccttgtatggtacggagagtttagatagttaatgaaggtggtgaatcagaaactgaatgaatgactgctaaaaaagacctccattttcttctttactgttagcattttaccttttgaaatactagaaaaatatacatacttatatgggcttcacctaaactgaggtgaattaactaagatatacattcaagatacaggaaccatctggtatttgttatagtgacatactccagaatatctttcatctgtttttcacaactacaagtcataggaattacatttataaacatttctcaccatgttacataaaatatttctattttatttatattctacttaaaatgaatgttttattgtgttctgtttattagtaaattatccatattaattatccctttgttataaataaagaataagtctttcttatctgtaaa

SEQ ID NO: 6123 - DNA, 2203 bp, Homo sapiens
tgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctggaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaag

SEQ ID NO: 6124 - DNA, 3481 bp, Homo sapiens
aaacagaaggcagatagagagggagtgagaggcaggagctgagacacagatcctggaggaagaagaccaaaggaagggggcagagacagaaagggaggtgctaggacaaaactcgaaaggtggccctatcagggaagcagaggagaggccgttctagggaagcccagctccggcacttttggccccaactcccgcaggtctgctggctccaggaaaggtggaggagggagggaggagtgggagaatgtgggcgcagggtgggacatgggcatggccaggggcagcctcactcgggttccaggggtgatgggagagggcactcagggcccagagctcagccttgaccctgacccttgctctccccaatccactccggggctcatgaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaggaa

SEQ ID NO: 6125 - DNA, 2361 bp, Homo sapiens
aacctcagaaaactgatttatccttgggaagggtcagtttcttcattaggacaatgaagaaaaatccagctgtcccttccaaggggaggtatcatgagcagtatcaaggggaacaagctggaggagcaggaccctagacctctgcagcccataccaggtctcatggaggggaacaagctggaggagcaggactctagccctccacagtccactccagggctcatgaaggggaacaagcgtgaggagcaggggctgggccccgaacctgcggcgccccagcagcccacggcggaggaggaggccctgatcgagttccaccgctcctaccgagagctcttcgagttcttctgcaacaacaccaccatccacggcgccatccgcctggtgtgctcccagcacaaccgcatgaagacggccttctgggcagtgctgtggctctgcacctttggcatgatgtactggcaattcggcctgcttttcggagagtacttcagctaccccgtcagcctcaacatcaacctcaactcggacaagctcgtcttccccgcagtgaccatctgcaccctcaatccctacaggtacccggaaattaaagaggagctggaggagctggaccgcatcacagagcagacgctctttgacctgtacaaatacagctccttcaccactctcgtggccggctcccgcagccgtcgcgacctgcgggggactctgccgcaccccttgcagcgcctgagggtcccgcccccgcctcacggggcccgtcgagcccgtagcgtggcctccagcttgcgggacaacaacccccaggtggactggaaggactggaagatcggcttccagctgtgcaaccagaacaaatcggactgcttctaccagacatactcatcaggggtggatgcggtgagggagtggtaccgcttccactacatcaacatcctgtcgaggctgccagagactctgccatccctggaggaggacacgctgggcaacttcatcttcgcctgccgcttcaaccaggtctcctgcaaccaggcgaattactctcacttccaccacccgatgtatggaaactgctatactttcaatgacaagaacaactccaacctctggatgtcttccatgcctggaatcaacaacggtctgtccctgatgctgcgcgcagagcagaatgacttcattcccctgctgtccacagtgactggggcccgggtaatggtgcacgggcaggatgaacctgcctttatggatgatggtggctttaacttgcggcctggcgtggagacctccatcagcatgaggaaggaaaccctggacagacttgggggcgattatggcgactgcaccaagaatggcagtgatgttcctgttgagaacctttacccttcaaagtacacacagcaggtgtgtattcactcctgcttccaggagagcatgatcaaggagtgtggctgtgcctacatcttctatccgcggccccagaacgtggagtactgtgactacagaaagcacagttcctgggggtactgctactataagctccaggttgacttctcctcagaccacctgggctgtttcaccaagtgccggaagccatgcagcgtgaccagctaccagctctctgctggttactcacgatggccctcggtgacatcccaggaatgggtcttccagatgctatcgcgacagaacaattacaccgtcaacaacaagagaaatggagtggccaaagtcaacatcttcttcaaggagctgaactacaaaaccaattctgagtctccctctgtcacgatggtcaccctcctgtccaacctgggcagccagtggagcctgtggttcggctcctcggtgttgtctgtggtggagatggctgagctcgtctttgacctgctggtcatcatgttcctcatgctgctccgaaggttccgaagccgatactggtctccaggccgagggggcaggggtgctcaggaggtagcctccaccctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcc

SEQ ID NO: 6126 - DNA, 1306 bp, Homo sapiens
ctctaaggcggccacacgggcatggccgtggggctggcgactggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggcagaaagaagaaagttggaggaacggaccaaagggtcctggctgaatgggcacctccttaagagttttccaggaatcaccacccaacgacttccactcacctctcgatggccaccccattagcaagagaatcagagcttgatggcaggtcccatttggtccccacaacataataggacttctgttaaggaaggacgggagaatggagactgcataggcaactagctgtccctgccaaggcccacatttaaaatgattgtaattgtaaaggaagttgtaaagaaatgtctatataggtataagttccatttggcttcttacgagcttccaaatgttctccgtgtgtgtaaactgagtcttgaaagaggggaagagggttaccgaggacaagagtgagtgggaggcgacccaggtggaggcagtgtgagtgtggggcggcaggttggaggaagagcaggcatgcaacggaagcctcttaccagatgctcacctcagagttggcatttctcacaagacacactcctagaaggggactgtgaagacaaagatacaaatgcttttagagaaaggttgctgccaggaccatgtgagggtgcccatctcaccaaacctcccacattgtgcactgtcatttgaaaaatactttgtcagtttgacaggtggaaatatcttgaatttgttgatgaaactaaacattttaaaaagca

SEQ ID NO: 6127 - DNA, 2637 bp, Homo sapiens
ctggtgtttagcaactccgaccacctgcctgctgaggggctagagccctcagcccagaccctgtgcccccggccgggctctcatgcgtggaatggtgctgtgccccttgccagcaggccaggctcaccatggtgccgcatgccatcttggcacgggggagggacgtgtgcaggcggaatggactcctcatcctgtctgtgctgtctgtcatcgtgggctgcctcctcggcttcttcttgaggacccggcgcctctcaccacaggaaattagttacttccagttccctggagagctcctgatgaggatgctgaagatgatgatcctgccactggtggtctccagcttgatgtccggacttgcctccctggatgccaagacctctagccgcctgggcgtcctcaccgtggcgtactacctgtggaccaccttcatggctgtcatcgtgggcatcttcatggtctccatcatccacccaggcagcgcggcccagaaggagaccacggagcagagtgggaagcccatcatgagctcagccgatgccctgttggacctcatccggaacatgttcccagccaacctagtagaagccacattcaaacagtaccgcaccaagaccaccccagttgtcaagtcccccaaggtggcaccagaggaggcccctcctcggcggatcctcatctacggggtccaggaggagaatggctcccatgtgcagaacttcgccctggacctgaccccgccgcccgaggtcgtttacaagtcagagccgggcaccagcgatggcatgaatgtgctgggcatcgtcttcttctctgccaccatgggcatcatgctgggccgcatgggtgacagcggggcccccctggtcagcttctgccagtgcctcaatgagtcggtcatgaagatcgtggcggtggctgtgtggtatttccccttcggcattgtgttcctcattgcgggtaagatcctggagatggacgaccccagggccgtcggcaagaagctgggcttctactcagtcaccgtggtgtgcgggctggtgctccacgggctctttatcctgcccctgctctacttcttcatcaccaagaagaatcccatcgtcttcatccgtggcatcctgcaggctctgctcatcgcgctggccacctcctccagctcagccacactgcccatcaccttcaagtgcctgctggagaacaaccacatcgaccggcgcatcgctcgcttcgtgctgcccgtgggtgccaccatcaacatggacggcactgcgctctacgaggctgtggccgccatcttcatcgcccaggtcaacaactacgagctggactttggccagatcatcaccatcagtatcacagccactgcagccagcattggggcagctggcatcccccaggccggcctcgtcaccatggtcatcgtgctcacctccgtgggactgcccaccgatgacatcaccctcatcattgccgttgactgggctctggaccgtttccgcaccatgattaacgtgctgggtgatgcgctggcagcggggatcatggcccatatatgtcggaaggattttgcccgggacacaggcaccgagaaactgctgccctgcgagaccaagccagtgagcctccaggagatcgtggcagcccagcagaatggctgtgtgaagagtgtagccgaggcctccgagctcaccctgggccccacctgcccccaccacgtccccgttcaagtggagcaggatgaggagctgcccgctgcgagtctgaaccactgcaccatccagatcagtgagctggagaccaatgtctgagcctgcggagctgcaggggcaggcgaggcctccaggggcagggtcctgaggcaggaactcgactctccaaccctcctgagcagccggcaggggccaggatcacacattcttctcacccttgagaggctggaattaaccccgcttgacggaaaatgtatctcagagaagggaaaggctgcatgggggagccccatctagggagtgatgggcccggcattgcctgaggccccgctgtgacagtttccccggtgtgagcccggtgagggcggcaggcaggggttatccggccccactttctggatgacagacttgaggctctgagagctgaaaacacttgtccaaggtctcacgttaaggtcaagacactaactcaaatctttcaagccccgcctctcctcttggaggacagggcagcctgcagctgtgtccaggcccaggccccaccccataacaggtggcctcagccacacagttctccccaaggggagcagcccagggccaagccccgctgccttccccaggccacagtgcgtccagtctcctgtcctgccacgtgtcttttgcaaagctccttggatgtggagacagatgtctttactagagctgaaaggcccccttgacacatccaggccaacctcccatggaataggtaggcaagccaggactccgggaaggaggtgcagccaggatgctctggtggagctgccgatggggccctggtgtcagaactccccaaaggcctgtgcgtccaagtggagtcaggttttctattcctttctgtgtttgcaaattcagtgttaactaaataaaggtattttgtttttca

SEQ ID NO: 6128 - DNA, 1719 bp, Homo sapiens
gatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctg

SEQ ID NO: 6129 - DNA, 1794 bp, Homo sapiens
actggcatcctgactccttgagaaagagcccatctagcatccttctcgccgttgcttccagcaacatggcccttcttccagctttaggatgtcctaagcgcttccagctgtccaggtcacactctgtcgcatgtcgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtatgcacctgtgggcatcctgttcctgattgctgggaagattctggagatggaagacatggccgtcctggggggtcagctgggcatgtacaccctgaccgtcatcgtgggcctgttcctccatgccggcattgtccttcccctcatctacttcctcgtcactcaccggaaccccttccccttcattgggggcatgctacaagccctcatcaccgctatgggcacgtcttccagctcggcaacgctgcccatcaccttccgctgcctggaggagggcctgggtgtggaccgccgcatcaccaggttcgtcctgcccgtgggcgccacggtcaacatggatggcactgccctctacgaggccctggctgccatcttcattgctcaagttaacaactacgagctcaacctgggtcagatcacaaccatcagcatcacggccacagcagccagtgttggggctgctggcatcccccaggcgggtctggtcaccatggtcattgtgcttacgtcggtcggcttgcccacggaagacatcacgctcatcattgccgtggactggttccttgaccggcttcgcacaatgaccaacgtactgggggactcaattggagcggccgtcatcgagcacttgtctcagcgggagctggagcttcaggaagctgagcttaccctccccagcctggggaaaccctacaagtccctcatggcacaggagaagggggcatcccggggacggggaggcaacgagagtgctatgtgaggggcctccagctctgcccccccagagaggagggaagggggctggggaggggagtcctggtgacacatctgttgcccaactgaccgtgggctgaacacacgttctgcttgactcatttaggggggagggaaaagtgaaataaaggagcaggaatgaaaggt

SEQ ID NO: 6130 - DNA, 889 bp, Homo sapiens
agaagcagcattgtggtttcaggagatgggtccatttggagcaggatcctaagtggggcttggcattgggaatttggattagctctagaggacgcaggatctggaaaatcagggcagatttcccatcccttggatatggtggggagttgaggagggcaaggaagatcccagaaaagccagtggcagcaaaacacaaaggccagggacctacgtactggtaaaactgagacctccaagaaacctgcagctcgacctggttgaattcagatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacaggtcagggggaagtacacagtttga

SEQ ID NO: 6131 - DNA, 1772 bp, Homo sapiens
ggtccggtccccgcgccggtgctgcacagtccctggcgggtccccgcggccccggccgggcgcttcgccgggctccggctcctgcatccgggcgcagcgcgcaggccgaggcgcgggcaggccgcccccgccgctccggacgccgatagaccatgagcagccatggcaacagcctgttcctgcgggagagcggccagcggctgggccgggtgggctggctgcagcggctgcaggaaagcctgcagcagagagcactgcgcacgcgcctgcgcctgcagaccatgaccctcgagcacgtgctgcgcttcctgcgccgaaacgccttcattctgctgacggtcagcgccgtggtcattggggtcagcctggcctttgccctgcgcccatatcagctcacctaccgccagatcaagtacttctcttttcctggagagcttctgatgaggatgctgcagatgctggtgttacctctcattgtctccagcctggtcacaggtatggcatccctggacaacaaggccacggggcggatggggatgcgggcagctgtgtactacatggtgaccaccatcatcgcggtcttcatcggcatcctcatggtcaccatcatccatcccgggaagggctccaaggaggggctgcaccgggagggccggatcgagaccatccccacagctgatgccttcatggacctgatcagaaatatgtttccaccaaaccttgtggaggcctgcttcaaacagttcaagacgcagtacagcacgagggtggtaaccaggaccatggtgaggacagagaacgggtctgagccgggtgcctccatgcctcctccattctcagtggagaacggaaccagcttcctggaaaatgtcactcgggccttgggtaccctgcaggagatgctgagctttgaggagactgtacccgtgcctggctccgccaatggcatcaacgccctgggcctcgtggtcttctctgtggcctttgggctggtcattggtggcatgaaacacaagggcagagtcctcagggacttcttcgacagcctcaatgaggctattatgaggctggtgggcatcattatctggtgagtcctggtctgtgcccacgggatggtggagccagagctgggaagtcaggctgtggggaagctgccgaagggcttgctggggacttttggtcattcatttacgtattgggtgattcacttacccactcaccaactcattcattcatgtctttctgggatgatttcatcactagttgacttccttgttcatctgttcattcattcattcttctatgcattggttagttcatggaatatctcactctttcattcattcatgtccttctgcaatgattcattcactgctttgttcatctgttcattcactcattcttctatgcattgatgaaatcactcattcagtgatttattcatctatactcatgcttcaatgcattgatttactcatttcctcatgcatttattcattcatctatgcattggttaaatcactggccaactcactaactcattcattcattcacacttttctgcaatgatttgttcacttgttcactcccttgcttatctgttcattcactcattcttcaatacattgaccaagccattcactgacatttattcagctacatttattctttcatgcattggtttctggatttatttggtcattcatttatttattttgcaaaattaatgtatttttaattgacaaataaaaactgtatatattttcatgtgc

SEQ ID NO: 6132 - DNA, 2568 bp, Homo sapiens
ccttgaacacattgcatcatgattacatgaaagagctgctgaaatggtcatgtgttcagagactactacatctgtaggcttaatagtaaacgtttggttggttggttggtcggctggttggtttgctgcttagcatcaggacacccaccccttgtgtgggaaatatacaagtgtgtgagtctatgggttgaaatccaaaaagcctgatgctttttctcattcctggcaaccaagggatatgaccaaattgggtcaattgaatgcccttgcccctaactgtgaacagagagtagtgttacaaacaaggaataaaagattagaatcaatgccagtgtctttccattgccccatcgtgtcagggtccaagtgtccagtagctgtggtcccttaaccagcctgtacctttggccgtggcaccagctacctactttccctatgtccccaagttatctggtaaccattcaggaattttttttcctacttaggtatacaaaaaacagtgtcagtttttgcttgacagattaaatcatccttcagagatgcaggaaaactattagcagccaagggatgctgccaaggccagtgtctgggctctgcagttttctaacttgtgatattgggtcaccccactaagctccaggagagcagcgactgcatctggcttaatcattatgggatggccagctcccaattccatgccctaggcaaagagacattcagtgaatattgatttgacttcgacttgattgaacaaaatggtaacactgaactctaggtttcctcagtgtctgttacagatttcttgatcctgactgcttttaatttttttttttttagcaagaaataactaacgaatgatgacactaagctttaaattcaagtaaataggaggcttttttttttcgcataagcagaaatgaggaaatcaagaggaagagattagatttctgttgtgataaatcgaatctgttaaatgccatgactttttaattgtcttaatcacaagttaaaccggttgtgttgctgcttagatggctatatatttgtttaaaagtacagcagtccctcctactggactttgatcctacaaaaacaactgttatctaactcaccctcagactgtcactggaacacctgcatgaagaatgttctttcattttttaaaaacgattttgcatatatgatttatttcagctttcaaaatgattagaaaactttttattgttctacttttgttgcttgtgactatagaagaagcaaggatgtcatcgctcagttttctgaatatagagaagactgaaatactatttttcacaaagactgaagaaaccatccttgtaagttcaagctacgaaaataaacggcctaattccagccacctctttgtgaaaatagaagatcctaaaatactacaaatggtgaatgtggccaagaagatctcatcagatgctacaaactttaccataaatctggtgactgatgaagaaggagaaacaaatgtgactattcaactctgggattctgaaggtaggcaagaaagactcattgaagaaatcaagaatgtgaaagtcaaagtgctcaaacaaaaagacagtctactccaggcaccaatgcatattgatagaaatatcctaatgcttattttaccactaatactattgaataagtgtgcatttggttgtaagattgaattacagctgtttcaaacagtatggaagagacctttgccagtaattcttggggcagttacacagttttttctgatgccattttgcgggtttcttttgtctcagattgtggcattgcctgaggcgcaagcttttggagttgtaatgacctgcacgtgcccaggagggggtgggggctatctctttgctctgcttctagatggagatttcacattggccattttgatgacttgcacatcaacattattggctctgatcatgatgcctgtcaattcttatatatacagtaggatattagggttgtcaggtacattccatattcctgtttctaaaattgtgtcaacactccttttcatacttgtgccagtatcaattggaatagtcatcaagcatagaatacctgaaaaagcaagcttcttagagagaataattagacctctgagttttattttaatgttcgtaggaatttatttgactttcacagtgggattagtgttcttaaaaacagataatctagaggtgattctgttgggtctcttagttcctgctttgggtttgctgtttgggtactcctttgctaaagtttgtacgctgcctcttcctgtttgtaaaactgttgctattgaaagtgggatgttaaatagtttcttagctcttgccgttattcagctgtcttttccacagtccaaggccaatttagcttctgtggctccttttacagtagccatgtgttctggatgtgaaatgttactgatcattctagtttacaaggctaagaaaagatgtatctttttcttacaagataaaaggaaaagaaatttcctaatctaacaattaaagcattactgaattcctactctgggtagggcactgtgggaga

SEQ ID NO: 6133 - DNA, 1472 bp, Homo sapiens
ttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagagtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataacaaaggaggtggactttctgtagcaatgtatatatgtacaggattgtacatactagcaattctgaagacttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtgcaatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatc

SEQ ID NO: 6134 - DNA, 2798 bp, Homo sapiens
gagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataacaaaggaggtggactttctgtagcaatgtatatatgtacaggattgtacatactagcaattctgaagacttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtgcaatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatcaactcagcaggggtcatagatcgaatagatgctgaaaagcgtaagatatatgcattccttgacatcatttttaaagacattccttcaaatagtttccacacagaaattcctcactcccattatgagagattgtggttatatgtcttaaatttattataagctgcttcaaagaaagggtctgaatgtttgaattatgagtgaaatcatgtgaaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaaggtatttgagacaatttattaatgaaaatttccttggcagatttgacaaatgttggcaatatttttttagaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagtta

SEQ ID NO: 6135 - DNA, 1730 bp, Homo sapiens
tcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttggtaagtaaacatagtttaacttgtctattacaacttttgctgtgatattgtgtatatgaaagatttagtgaaagctggatttgttttactctttggttaagtataaaaattgttgaatcttttcatgtgccagtatccataccctgaagaaaagtagttaatgaataaagcaaatgttctcttacaatatattttggaggtttgggttttaaaattccatttaatgaattcaaggaatcaattaaaacactatgtgtctccttatagaggttatgtcaatatattgatcatttaatgaggtcttttagattattattattttgtatcatgggactgaggattttgaaaaggaaacatgacccagctggtcagaaagggaatgctaatttacttgttgacatgccatttattttgtacatttcactgtcaaagaagctactggcttggatgcttctgagaaatctatgtgaaaaaaaatttgaaaggaagatatgactaatgagtaatttgcaagtaaatgttgtatctatatatatatatatataaagattcaaaagtagttcagctttcataagtagaaccaatataaggacgttgttttagcatttttaatcattatttttaaataaatgatgtaacagaggcttgatttgtgttatgaaagattgagaaactaaattttctgttgatttaatttttttgtgccttaaaactttgttaaattcctgaagttaattatcatattgtattttttggggcataactcattagcagatatgtagtgcagtgatttacaaataattgagagtaaaatcagtgatgtataaactagttcatgagtctaggtaaaatatcaattacctctgtttaaaatgctctgttaattattattgtatgtatttaaatgtagttaaagcttttaaacatgttgttacatagtgttaattctacatagtgctacacagcttttagtgtcacatagccttacagagtttataatgatgtagcatctgcaaaatatatgcatagcttatatcctatttttatagagccagtaatggtttttgtgatgctgtattacttctgggttttagacaataaagtctgtttaacaaaa

SEQ ID NO: 6136 - DNA, 1331 bp, Homo sapiens
gtattctgaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagaaactactccaaaccagggggccactggctaacttgaataatccagaaggcttggaatatctatccatcaaatttgggcattaa

SEQ ID NO: 6137 - DNA, 3747 bp, Homo sapiens
gaggcgcgtggtagtgatggcggcgctcagtgagactttcctgtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgagggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagggagtgaagctgacaaggccgacagtataacaaaggaggtggactttctgtagcaatgtatatatgtacaggattgtacatactagcaattctgaagacttgtacttgtgaatgttgcctcaatgcatattttatttttttacacaaaaatatgagatcctgtttaagtgccttaaaatgtatttgacaagagcgttatttccaaaatatgctttgttgattactgccaggggtggtacaatatttgggggttaattttgctttcctaatgcaggaatcagtcatggtaagtgacaaaaagcaaacatgctttccctgcagcacctttgtgcaatacaaccctatagtagttactgtaatgtttgaaatgaggtcacaccatcaggaaaatgcccttctgatgacagtgaaaatttccaaagtcttattcatgcatactttgatttactgtgtgattctttttttctacgactgtgacatgcctcttccttatcaactcagcaggggtcatagatcgaatagatgctgaaaagcgtaagatatatgcattccttgacatcatttttaaagacattccttcaaatagtttccacacagaaattcctcactcccattatgagagattgtggttatatgtcttaaatttattataagctgcttcaaagaaagggtctgaatgtttgaattatgagtgaaatcatgtgaaattttgagttaaactctgtgatttgattttcagggtctttaaaatatatcttaatatcttcttcctctttattcaataatttctgtcttgcacttacacactcataacagccaaatatgaggcacaaaaatgttacaatcagtttgaaagcagcatcaattaatggtagattctattcacattccacaacccagaccaaatttttttcctattacgcagatgtgctgagcactttccagattgcccctgttggccaaaagcagcctgttacatcctggaattaagcacacttaaggtatttgagacaatttattaatgaaaatttccttggcagatttgacaaatgttggcaatatttttttagaagttaaatcatattgctttcatgaataaatgaaaatataaaggtcatggatgcaaacaaatgttacatatacacattctgtctctccagatgaaaagaacatgcaaaaccatttaataaccaaaatatcaagtaaaattagttcccaacggggcagcagctttcaaatgagtgtccaatatttgcttctgctatagctgcaagaactgtaactggacccaagtagagaatgaagccacgtatagaactacgagaacacttttctgtgtttcccccatgccgtcctgtcacatcctcttacacgtcctctcttgatttgatagacaatattggcatcctgggtctcactgaggccgtgctatgtcctcagcagctgtttttgttgtttcgttattatgcccacaacaaaaaatcattccttagaaactcaccaagtttatctactgtgtaaatttatattattgttactaccaggtctcatcttttgtcaatgtcattgaataaatttcataagagttattctcagtgtgaattttaaggctaatgccagatcctgcaaaaatctatgctaaccaggctgtagtacacactgttataaagaattttacttgtgtctaaaactacagtaattttgcttaggtaattgtgcttacctatggagcacaggaaggctcttaggttttgttcctacaagtttctttgaattttggagtaaatggaagtgtctgtctgtctgtcatctatctgccctatcataaaaatctttctccctaacattaaaatactgatccccgcccccaacttatctacctctattgtctaacacctatagtaggtgtgatcatgggataaaattcaactgaaaatgctatgataacattttatcgtttgctttaaaaatgtgctttgttttcaaataatctttacatagtgaactttggtggcgttagtgatatgtttatgcctatttcttttttttacacaaattccttggcatattttttcataaagaacaaaaaataaaatcaaaatttatttttaattcatgcttattgggatttaattattcagagcttaaaatattttgttatgtttatacactgtaaagctatctgttttatgcatttgttttgtctaaatgtatttatgaaagaaatacattagattatatttatgtttactcatttttccacctggattttttttaatggttgttacaaaattagattttttaatgggtaataatgttggtattttcatgttttttcttagtattaaaatttttgtgggttttttaaaatttttccctattctgttaaaaattaacacacctctagctaatgttcagtgtttgtgctaaataccaaattttttcaaaaggattggttaagtcataaagtggattatttatgatgactggaagatgaaaataattatatgattaaacaaagaatgtttcagaaatcacaagagaaa

SEQ ID NO: 6138 - DNA, 1638 bp, Homo sapiens
gtcactggctactactactcccaaccctcctcaaagccgccggagcaacccccaggtctttactttacaatcggcaatttgacttgctctgctgcatgtctggagggaccaaggaaagtgtggagacgctccaaggattaggtgatcggagcttgaaaagaaaaaaagccaaacaaataaacaaaacccacccaccctaacaaatatgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagagcttcttacttaatgcgattctgcgaagcagccaactttgtgggatgcaggagttgaagaaggaagaatgccacagctgtcagcatttctctaaggactgacttcttttgtaagcacctaagaaaccttcagagtcatccagctaatttggatctaatgaaatgccgtgatctcgtgctttatcgtggtatctaagcagcaatcaaagccatttcttccatcaaaagcccttttcaaaagaatacaacattaagtcattttcaaaagccatataacttaagatgtcctagattgtatcattgtgtaatattaaaccacttctaaagcctgctaatttcatggttaacttgtaacttaggaggtagcagtcatatttgtttactagttagtaatcctaaattcatttcagtggggattacgatttatatgtcttattaggtcctaaaatagttcatttttgcatacaagagacagtgaattattattgacttgagtttatttggaagcatttgtgttggtcccattcaagtttgatttatattgaacatttcttatatgactcatacattgatttaatgacatgtattctaaaatttgttttagtaatttgttaaaattataaaggacactgtgctaatgcaatgctgagtcttcagttttatgacaacttctagttttttgaaattttgttgtattgaagtgaaatatggttacatttaaaattcatatttagttcacttcaaacctgtagtttcagaggctttgtcacttagccgactgtggcagggcgaatttgtttaaacaagtatcaattaagtgcttatggccacaaggcacggtgctggggatagaaacaaaggtgagcaggagacttaggggctgagaaaaggtcctgagtagggcagaagatgcaggcttttatttttctgtaaaaattattatcttttatcctattagcagaaaagcaaatatagcaaactctaaactttagatgtgtgctgtttgtttcaagcccagagctatgagcctgactctcagcaaatgaatgagatggtcagataaagggttacaagagaaatcggtgtctaatgaaaatatttctacgtcccaattagagccctggttttaagcaatgcttgatgctgtcaatgagactctggtataatcagtaaatgatgtggagtgtcttcttaagtttattttaatggattttgaccttattacatatgaataaacaaactatgatgcaga

SEQ ID NO: 6139 - DNA, 1134 bp, Homo sapiens
atgaggctgctggagagaatgaggaaagactggttcatggtcggaatagtgctggcgatcgctggagctaaactggagccgtccataggggtgaatgggggaccactgaagccagaaataactgtatcctacattgctgttgcaacaatattctttaacagtggactatcattgaaaacagaggagctgaccagtgctttggtgcatctaaaactgcatctttttattcagatctttactcttgcattcttcccagcaacaatatggctttttcttcagcttttatcaatcacacccatcaacgaatggcttttaaaaggtttgcagacagtaggttgcatgcctccgcctgtgtcttctgcagtgattttaaccaaggcagttggtggaaatgaggcagctgcaatatttaattcagcctttggaagttttttgggcatcgttataacacccctgctcctgctgctttttcttggttcatcttcttctgtgcctttcacatctattttttctcagctttttatgactgttgtggttcctctcatcattggacagattgtccgaagatacatcaaggattggcttgagagaaagaagcctccttttggtgctatcagcagcagtgtactcctcatgatcatctacacaacattctgtgacacgttctctaacccaaatattgacctggataaattcagccttgttctcatactgttcataatattttctatccagctgagttttatgcttttaactttcatcttttcaacaaggaataattcgggtttcacaccagcagacacagtggctatcattttctgttctacacacaaatcccttacattgggaattccgatgctgaagatcgtgtttgcaggccatgagcatctctctttaatatctgtacccttgctcatctaccacccagctcagatccttctgggaagtgtgttggtgccaacaatcaagtcttggatggtatcaaggcagaagaaactactccaaaccagggggccactggctaacttgaataatccagaaggcttggaatatctatccatcaaatttgggcattaaaataaataccaagagtccatcctccagggagtgaagctgacaaggccgacagtataa

SEQ ID NO: 6140 - DNA, 3986 bp, Homo sapiens
ggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggcattgccaaagagctttaatatccagtaacaagatccagaaaccacactttaaccagtgatcagttttccgtgctgcattgtaactcagctcattctggcattcaagttttaggcaaaaaaagaggaaacttctaacatttagcttgtaagtcctgacataagatagtgaagatatttatcttctttctaatatttgtatagtccgccaatgtattttcttcccactattcccattaacataccaaacactgtttctaggtccaaagtctatttctaggagtggccaatatttgtattgttgaatctcctagggaatgctaaatgtttcactttaaaatacctatttataccaagtagcatgagattagtactagagtgagatttggaatattagtccacatatcacaaactgcttgcctacatgtatagattttttttttcacccaccttcctaaccaggaatttgtttccttaaatttgttgttgttgttgttgttgtttgttgttatttttttgagaagagtcttgccctgtcgccaaggtgggaatgcattgacgtgatctcagttcactgtaacctctacctccccggtttaatcgattctcctccttcagcctcctgaatagctgggattacaggcaccacatttttagtggagatggggtttcaccatgttggccaggctggtctcaaactcttgacctcaagtgatctacctgcctcagcctcccaaagtgctgggattacaggtgtgagccactgcacccagcgttttttgttgttaagacagggtcttgctctgttgcccaggctggagtgcagtggtgtgatctcagctcactgcaacttctgccacctgggcttaagccatcctcccacttcagcatcccaaatagctgggactgcaggcacacaccaccacacccagctaatttttgtattttttgtagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaacttactacatttcaataaaactttttaaaaaatccagacattgcctatgttcgtttataatcggcccttaaagaggcagggatttttctaaaatgacactttaaaatttcctcatttctacttcagggcctcttgaaacttcagataatgagagcagccaaccctgcaactcaggctatagagtccttctgatcttaaaactgagactgaattcacatcagttttacgcttttacttgaaaaagagactcttaagtgtttttggtttctttatacaggacaacaa

SEQ ID NO: 6141 - DNA, 4132 bp, Homo sapiens
agcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 6142 - DNA, 4156 bp, Homo sapiens
atatatagaggcaggagctggcattgggaaagtcaaactagttctgcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaatgagtatgcaagttttatttatcaaaatgtaatggatttttaaaggctgagaaattttccttatacctaccttttcagttattttaattataccaaattatcaactagaatagcttcatccatatgaaatataaaatgaagagacacctagctctatcaggcttaggattctttgaacttatttccactttaatttctcagtggaagttaagaggggtgagaaaacaaagaaggggaaaaactgacaactaacaaaaccagcaccacatcgctaggtggtgcttactaattaccttctcaggattttcctcagattgaaaagcttatgaggatttcttgggagtcttaataacctgcctgttagtacagagctttcctgatgatatttactcttgagcacatgtggttgtaaaaccttaactttctttctccaggagggtggtgatagaaacagatggtagtatttatgaactgatgttctcgtgaaatgttgagggtggggagaaaagactttaagggaggagagccatctattttgttcctaaagccacctctcagcagaatcgtcatgtttttctgatgcaccgctctgcttcatgcccaagatgacttgcgaggcaatctcaggagctgtggacttaaccgttgcaaagcacactgtctttctcagcgttctctgcaagtcagtaggtgttagtatggttgcaaagttcactgtctcagcaaagttgaactgggctacctctctacagctgtttcctcagagggaaaaatcttgagaccagatggtggagctctggagtcagaggaaatgggtgtcttcagcacaaagctgctgcttttacttcagccacttctgacatttttacataccgagcctgagattgtgtgattatctcaaatcaaatcactttgatggagataaataatcaaaactgttttatagtcattgatttggtgagaacagtaatggaaaatggtgttgaaggacttctcatttttggagctttccttccagagtcctggctgattggtgttcgctgttcatctgagcccccaaaagcattattactgatacttgcacacagtcaaaagcgcagactggatggatggtcttttataaggcatttaagggtacactactgtgtttcactgaccatacatttttcttagcccctcaagtaatatagcacagagttatgaatgacaattcccctaaccattcctcttcatatctgcctcttccccttaccatcgtaattctccaaactggtcataaaggcactctgtgaagatattggggactgacatcttaagctctcacctggctgcagtaggaaaggccaaactgacgacaaaaaaaaaattctttataaagatgatatggtaacatgtatctttgccctgggtctgggtgggtccagtcagtctcagatttacaagcatttaggagcctaggtaaaagctgctagtattcttttaaaagttatatttatgacttgcaatgatagaaaactccttccaattaaatggcattttataatattatgtgtgtacttcacagtgttaaaaataccctcatacgttattgcatttgatcttcacagaaagtgcattttaaccagtactctgggtgcaataaataatatgtagaaatttaagtcctccaattccagcatatccagtgagttttgacagtgtgtttatgtggaatgtttaaggatatacaattgtactttatataaattggttcttgttcttcttaaatgtgacatgaaataattgtgctgctacattatactggaaattaacaggggaaaagggaagagctcttggctcccttgaggttctgctagtggtgttaggagtggttacaactgagcttttagtaaccatttaaccgtatgtaaacttggtttctaattaaaaaaaaatttctttttccaa

SEQ ID NO: 6143 - DNA, 2470 bp, Homo sapiens
agagtccaggactgatggagtcgcgccattcagagaaagacccaaagatgggggcagggagggaacgccggaggtcgcgggggtctcgccccttccccgccgcggcctaggacacatggcccagctcccagctgcaccggatggcgcgcccggcctgtgtcggggtgcgctgacctgcttcgacgcctcgaaagaggccgacgggcacagggcaaggtctttcgtggcctcttcgtcggcgccgcagggggccgggctgctctccggggcctcccgccgccccgcttcaacaaaagactcattataacctaaccgacttcagggagcgccttctgtgtgaatagcctgcatacgcggctcagtaattaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaac

SEQ ID NO: 6144 - DNA, 1937 bp, Homo sapiens
agagtacaaagggttcctgcttggtggttttgctgcagcttcagagtttagcctgaactgtggcaggattttgtaacttgcacattttttgagaagtctgatggaggtataatgtccacggtcgattatttgaacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttg

SEQ ID NO: 6145 - DNA, 2125 bp, Homo sapiens
ccggaatatggagccctgggcgcgggggcggcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagagagacgggatttcaccatgttgcccaggctggtgttgaactcatgagctcaagtaatctgctggccttggcctcccaaagtgctgagattataggcgtgagccactgcatccagctcactcctcatttctttctagccccaaaggtgttgagtcagcaaatcctgcagcctttgtgtgactttgagcatcactttcccctttcagcattaaatatatgacctctctgccttattttagaa

SEQ ID NO: 6146 - DNA, 1740 bp, Homo sapiens
ggggagggcgttagccagcgtggcgctggctcccggaatatggagccctgggcgcgggggcggcgtgtcaggtggttgcggagctggtaagaatcatattctaagaactcagccactcaggtatccaccatggtgctgggtcctgaacagaagatgtcagatgtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactg

SEQ ID NO: 6147 - DNA, 2486 bp, Homo sapiens
gcgtgtcaggtggttgcggagctgaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacgtgccatctgggattgacagctcagcctgaactctatcttctgaacaccatggacgctgactcacttgtgtctagatgactgacagcctgagagactctataagaacatgtttttctaagccctttttgtgccaggtgtcccgttaacgtctctgttagttcagaggtgagttttgttcagacgttttgaacaaaaggcaaagatttcctcatgggaagggtgttcaaaactgacagctataaatgtaggtcagagacccacccacctcataacagtcatacactcccagagttaaacgattggcctctgatggccacacacccctatgggcttgtgtcttggactctgggatttaaaagatatatatgtatatatatttatgtaaacctgagcatctcagtttgggtagagttttaaggttatatgaaactgatagaacttttgtattttttttttaaatattgttttgatatatcagatatttgttttgtctggatcacaagtgagaaagaaaagagaacaatgctctttttcacaatgaactggtcaaattgactatcttgtaaagtgatactttactatgtcagtgaaatttcagtttgattttagtcaaccagattatatcctttgtatctactgatattaacacatcatattaacacatcatttcttaaaaaaacatttcttctgtttggcaatcataattaactctggttatcagcctattttgtaattattgtctttgtcgtcacttttcttgaattgttttctagtcattaaacagatatgaaggca

SEQ ID NO: 6148 - DNA, 2401 bp, Homo sapiens
ccctttcaaccactggcactcacaggcttgccacctactcttgctcctgccaaatggtcaaagatgaaatctgattaggctttggagggcgtggtttgcctcttgaaattccttgctcgtctttagaaagctgtgttgcttagagcacccaaaagtgccctttatctaactgagggaggcgcacttgtcttcatatatagaggcaggagctggcattgggaaagtcaaactagttctgcaccatgaggaagaagcagctgaagacggaggcagctccacactgtgaactaaaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctgtggctgatggtggagttggctatcatcggctcagacatgcaagaagtcattggctcagccattgctatcaatcttctgtctgtaggaagaattcctctgtggggtggcgttctcatcaccattgcagatacttttgtatttctcttcttggacaaatatggcttgcggaagctagaagcattttttggctttctcatcactattatggccctcacatttggatatgagtatgttacagtgaaacccagccagagccaggtactcaagggcatgttcgtaccatcctgttcaggctgtcgcactccacagattgaacaggctgtgggcatcgtgggagctgtcatcatgccacacaacatgtacctgcattctgccttagtcaagtctagacaggtaaaccggaacaataagcaggaagttcgagaagccaataagtactttttcattgaatcctgcattgcactctttgtttccttcatcatcaatgtctttgttgtctcagtctttgctgaagcattttttgggaaaaccaacgagcaggtggttgaagtctgtacaaataccagcagtcctcatgctggcctctttcctaaagataactcgacactggctgtggacatctacaaagggggtgttgtgctgggatgttactttgggcctgctgcactctacatttgggcagtggggatcctggctgcaggacagagctccaccatgacaggaacctattctggccagtttgtcatggagggattcctgaacctaaagtggtcacgctttgcccgagtggttctgactcgctctattgccatcatccccactctgcttgttgctgtcttccaagatgtagagcatctaacagggatgaatgactttctgaatgttctacagagcttacagcttccctttgctctcatacccatcctcacatttacgagcttgcggccagtaatgagtgactttgccaatggactaggctggcggattgcaggaggaatcttggtccttatcatctgttccatcaatatgtactttgtagtggtttatgtccgggacctagggcatgtggcattatatgtggtggctgctgtggtcagcgtggcttatctgggctttgtgttctacttgggttggcaatgtttgattgcactgggcatgtccttcctggactgtgggcatacggtaagcatctctaaaggcctgctgacagaagaagccacccgtggctacgttaaataacactggattagtctgtcttctgcaggtagccatcagagccagtgtgtttctatggtttactgtgtgaacatagccaaaagtatgtgccgttgcacagactgtgtttatgactcaaccgttggttggaaaagactttgtttcatgtgtatttgaaagatggaattattttttccttcctgacctaaccttagaactggattagggtgggatctttgaaaagctgacatttgctgctatcattccaacactaaattcttaagtagttgcccaagggccagctcagtttatccttcggagagacaaggatatgcatgattcttaaccaggctatatgttaaaaaaaaattggaaaatgcaatacattttttattatacaaactacagaa

SEQ ID NO: 6149 - DNA, 530 bp, Homo sapiens
ggcagcacttcttgttaaggaatggggaagcttcttatgaatctaatcttactctaatgttaggaaatcagcagtggtcccttggattactctacaaagctagtaggcagctttggttcagttatgactcagtgaaggttagagaattatatctacaaagtaggatctttttctttctttctttcgttttttgatacggagtttcgctcttgttgcccaggctggaatgtaatagcgcgatctcggctcactgcaacctctgcctcccgggttcaagcgattctcctgcctcagcctcttgatgcctggcgaattttttttgtatttttagtagtgacggggtttcaccatgttggccaggctggtctggaactcctgacctcaagtgatccacctgtatcggccttccgaagtgctggggtggtgtgagccaccgcgccctgccagatctttcttgtttgactttcattgctaagaatttggaatcatattctaagaactcagccactcaggtatccaccatggtgctg

SEQ ID NO: 6150 - DNA, 576 bp, Homo sapiens
agcgtggcgctggctcccggaatatggagccctgggcgcgggggcggcgtgtcaggtggttgcggagctggtaaggtgaggggaaggcaagaatcatattctaagaactcagccactcaggtatccaccatggtgctgggtcctgaacagaagatgtcagatgacagtgtttctggagatcatggggagtctgccagtcttggtaacatcaaccctgcctatagtaatccctctctttcacagtcccctggggactcagaggagtacttcgccacttactttaatgagaagatctccattcctgaggaggagtactcttgttttagctttcgtaaactctgggctttcaccggaccaggttttcttatgagcattgcctacctggatccaggaaatattgaatccgatttgcagtctggagcagtggctggatttaagttgctctggatccttctgttggccacccttgtggggctgctgctccagcggcttgcagctagactgggagtggttactgggctgcatcttgctgaagtatgtcaccgtcagtatcccaaggtcccacgagtcatcctg

SEQ ID NO: 6151 - DNA, 3447 bp, Homo sapiens
tccagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacacccaaaagatatatagagtgaaaagtctccctccaatccttattctccacctgctcagttcctgtctaccctggcctagaggtaaccactattctcatccgtacatccagcatttctttatggatatacaagcaaatgggaatgtagagtctcacattctctctttatacacaaaagttagcacgttatacacatgttctgcaccttgcttttttcccttaacaatctatcttggagacatttcatatcaattcatatgccatttgttcatttttttcattgtataaatgtgttataatttatttcgccagttccacaatgatgagcatttggattctttccaatcttttgcaatgacaatcagctctgcagtgaataatcttgtacaaatgtgcaagcataaagtgtatctctaggataaattcccaaaagtggaattgcaggatcaaaaggtacatgcatttgtaaactattattgtttagtgagggtctttttaattaaagaattaacatgaattgcct

SEQ ID NO: 6152 - DNA, 2989 bp, Homo sapiens
agccacgtggcggcggggcggggaccgggcgggccgggcgctgggagctggctgtcccaggagcagagcagtctccctgtccagatcaccaggatccctgcttgctggagaatgacccagatgtcccaggtgcaggagctcttccatgaggcagcccagcaggatgccctggcccagccccagccctggtggaagacccagctgttcatgtgggagcctgtgctgtttgggacctgggatggtgtgttcacatcctgcatgatcaacatctttggggttgtgctcttcctgaggactggctggctggtgggaaacacaggagtgctcctgggcatgttcctggtgtccttcgtcatcctggtggccctcgtcacggtgctgtctggcattggcgtcggggagcgcagcagcatcggcagcggtggcgtctactccatgatctcctcggtcctgggtgggcagacgggaggcaccatcgggctgctctatgtgtttggacagtgtgttgcaggtgccatgtatatcaccggctttgctgaatccatctcggatttgctgggcctcgggaatatctgggctgtgcgaggaatttcagttgcggtgcttctggccttgctgggcattaacctcgcaggtgtcaaatggataatccgcctccagctgctgttgctgttcctgctggccgtgtccacactggactttgtggtgggttctttcacccacctggacccagaacatggtttcattggatattcacccgaactgctacagaacaacacgctgcccgattacagcccgggggaatcttttttcactgtctttggggttttcttcccagcggctacaggagtcatggccggcttcaacatggggggcgacctcagggagcctgccgccagcattcccccgggctccctggcagctgttggcatctcgtggtttctgtacatcatcttcgtcttcctcctgggcgccatctgcactcgagaggcccttcgctatgacttcctgatagcggaaaaggtatccctcatgggcttcctgttccttttgggcttatacatctcgtccctggcttcctgcatgggaggactttatggagctccccgcatcctgcagtgcattgcccaggagaaagtgatccctgcacttgcctgtctgggacaagggaaggggccaaacaaaacacccgtggctgccatctgcctgaccagcttggtgaccatggcctttgtttttgtgggtcaagtgaacgttctggcccccatcgtcaccatcaacttcatgctgacatacgttgcagtggactactcttacttctccctgtccatgtgttcctgcagcctgaccccggtgcctgagccggtgctcagggagggcgcagaaggcctccactgctctgagcacctgctcttagagaaagctcccagttacggctctgagggacctgcccaaagagtcttggagggcacgctactggaattcaccaaggacatggatcagctcctccagctaaccaggaagcttgagagtagccagcccaggcaaggagagggtaacaggaccccagaaagtcagaagaggaaaagcaagaaggccaccaagcagaccctacaagatagcttcctcttggacctcaaatcccctccttctttccctgtcgagatctctgacaggttgcccgctgcctcctgggaggggcaggagtcctgctggaacaagcagacttccaagagcgaagggactcagcctgagggaacatatggagagcaacttgttcctgagctgtgcaaccaatcagagtccagtggagaagatttcttcctgaagtccaggctccaagaacaagatgtctggagaagatccacttctttctatacccacatgtgcaacccctgggtctccctgttgggggctgttgggtcccttctcatcatgtttgtgatacagtgggtgtataccctggttaacatgggtgttgctgccatcgtgtatttctacattggccgggccagtccagggcttcaccttggatcagcctccaacttcagctttttccggtggatgaggtctctcttgctcccctcctgcaggagcttgcggtcccctcaggagcagatcatcttggcgccgtccctggctaaggttgacatggagatgactcagctcacccaggagaatgcagacttcgccactcgggatcgctaccaccactcctccctcgtgaaccgggagcagctgatgcctcactactagatgcagtgctgggaccttcctcttttggagctgtcccatgtacagtggacccaagctcaggaccttcgtggagctgcttctccaacctgagaaactcaagacccatcctcccgctgtcactttggacaatggaaatctacattttcttttccctttttttttttttttgagacagagtctcgccctgtcacccaggctggagtccagtggcacaatcttggctcactgcaacctctgcttcccgagttcaagcaattctcctgcctcagcctcctgagtagctgggattataggcatgcaccaccacacccagctattttttgtatttttactggagacagggtttcaccatgttggccaggctggtctcgaactcctgacctcgtgatccacccgtctcagcctcccaaagtactgggattacaggcgtgagccaccatgcctggccagaaatctatgttttcttagaacatgtggaagaaggaaaaagacaaaaaaggaaatctggattctgaggaccacgtctcacccagggtgacatcaggaatggtgctagcctctgcaacacgacacccagtctgaagagctctatacaggtactaagactagcaggggacaccaagactctgcacaaccagattgcttgtgcagagggccacaataagtgtatgttttatattttattgtattatttattcaaaaataaataatacactcacatgtttccacaccc

SEQ ID NO: 6153 - DNA, 1759 bp, Homo sapiens
tcccggtagccgcagctgtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtcaaactcgcatcccctgccgtga

SEQ ID NO: 6154 - DNA, 3273 bp, Homo sapiens
gtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcgcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacac

SEQ ID NO: 6155 - DNA, 1912 bp, Homo sapiens
cccggtagccgcagctgtcttttccggcccccgtgcactctccgcccgagcggagccccccggctcgcggggatcgcccccgagcgctgcgtcctgcgggtgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtcaaactcgcatcccctgccgtgaaacagatgccccgctagaagccgggagtggacagcatcctcctctccatagaattggagtgctcattagtggcaagaatcctaaggcgaactttgcctgtttaagtggaggagattagtcactgagataataaaataaatgcatgtgaaa

SEQ ID NO: 6156 - DNA, 2026 bp, Homo sapiens
tcccggtagccgcagctgtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtcaaactcgcatcccctgccgtga

SEQ ID NO: 6157 - DNA, 589 bp, Homo sapiens
ttcctcttgcattgctagttaaggaaggagaggctggagaagcctgtgccgtcagagaacctttgcccctttccagaaccggtgccatccctagtctcaggaacataagggaaggggtggcccccaggagccgggaggggccttgaaacccctgctgacaggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgt

SEQ ID NO: 6158 - DNA, 2025 bp, Homo sapiens
cactttggggtacactggcattctttggtgttcactggcattttgggggtgcactggcactttggaacaacggcacgcctcttggcccttgcccagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcggtggcatgaagcccaacacgttggtcctaggtttctacgatgacgctccaccgcaggaccatttcctgacggacccggctttctctgagcctgcagacagcaccagggagggcagttccccagctctgagcaccctgttccctcctccccgggctcctgggagcccccgggccctcaatccccaggactatgtggccacggtggccgacgccctcaagatgaacaagaatgtggtgctggcccgggccagcggggccttgccccctgagcggctgagccgggggtctgggggcacctctcagctgcaccatgtggacgtgtggcccctcaacctgctgcggccccggggtgggcccggctatgtggatgtctgcggcctcttcctgctgcagatggcaaccatcttgggcatggtgcccgcttggcatagcgcccggctccggatcttcctgtgcctggggcctcgggaggcgcctggggcggccgaggggcggctgcgggcactgctgagccaactgaggatccgggctgaggtgcaggaggtggtgtggggcgagggggccggggctggggaacccgaggcggaggaggaaggggactttgtgaacagtgggcggggagacgcagaggcagaggccctggcacgcagcgccaacgccctggttcgggcccagcaggggcggcacaggaggagggccgggtgggccggagggtggggatgctgagggccccatcacagccctcaccttcctgtacttgcctcggccgccagccgatcccgcccgatacccccgctacctggcgctactggagactctaacccgagacctgggccccacgctgctggttcatggggtcactccagtcacctgcactgatctgtgatgcccctgcctccagggctaggtagagagggcccaggcaggcggcctatcctgatccttggaggaggaggaagaggaggccactgtggcccgtggccctgcccttgggacgtggagcccaggggaggtttgaaggggatcctgggcttgggcatcacgcccacctcctttggcagagggaccccagcacactaactctgggtggctgtccccaccgtgcaggggagggagtccgcagcctcccttcactggtgccttgatgctaggggccaggcctcctctgtgactctgggctacctcagtttccccattttggccagactcaccggcccactggggtggtgatgttttcgttctgttttatttttctaactctgctgaccatgaataaaagaccaaaacact

SEQ ID NO: 6159 - DNA, 2089 bp, Homo sapiens
aggctccaggcctggcatcccggtagccgcagctgtcttttccggcccccgtgcactctccgcccgagcggagccccccggctcgcggggatcgcccccgagcgctgcgtcctgcgggtcacctaacccatttgtggcttcctctacctgtgctcagccatggccagcgagagctcacctctgctggcctaccggctcctgggggaggagggggttgccctccctgccaatggggccgggggtcctggaggggcgtctgcccggaagctgtccaccttcctgggtgtggtggtgcccactgtcctgtccatgttcagcatagttgtttttctgaggattgggttcgtggtgggtcatgctgggctactgcaggccctggccatgctgctggttgcctacttcatcctggcactcaccgtcctctctgtctgtgccatcgccaccaatggagccgtgcaggggggcggagcctacttcatgatcagccgcacactggggcccgaggtcgggggcagcattgggctcatgttctacctggctaacgtctgtggctgtgccgtctccctcctggggctggtggagtctgtgcttgatgtcttcggggccgatgccacagggcccagtgggctccgggtcctgccccagggctacggctggaacctgctgtatggctccctgctgctgggccttgtgggtggggtctgcaccctgggagccggcctctatgcccgggcctcattcctcacattcctgctggtctctggctccctggcctctgtgctcatcagttttgtggctgtggggccgagggacatccgcttgactcctaggcctggccccaatggctcctccctgccgccccggtttggccacttcaccggcttcaacagcagtaccctgaaggacaacttgggcgctggctatgctgaggactacaccacgggagccgtgatgaattttgccagcgtctttgctgtcctctttaacggctgtacaggcatcatggctggggccaacatgtcaggggagctgaaggaccccagccgggcgatccctctgggcacgatcgtcgccgtcgcctacaccttcttcgtctatgtcctgcttttctttctctccagcttcacttgtgacaggaccctgctgcaggaagactatgggttcttccgcgccatcagcctgtggcccccactggtgttgatcggaatctatgccacagcgctctcagcgtccatgagctcgctcattggtgcctcccgcatcctccatgccctggcccgggatgacctctttggcgtgatcttggcaccggccaaggttgtgtcccgagggggaaacccctgggcagctgtactttattcttggggcctggtgcagctggtgctcctggctgggaagctgaacacactggctgctgtggtcactgtcttctacctggtggcctatgctgccgtggacctgtcctgcctgagcctggagtgggcctcggcccccaacttccgccccaccttcagcctgttctcctggcacacctgcctgctgggggtggcctcctgcctgctcatgatgttcctcatcagtcctggcgcggctggtggctccctgctcctcatgggtctgctggctgccctgctcaccgcgcgaggaggccccagtagctggggctatgtcagccaggccttgcttttccaccaggtgcgtaagtatctgcttcggctggacgtccggaaggatcacgtgaagttctggcggccccagctgctgctcctggtggggaacccccggggcgccctgcctctgctgcggttggccaaccagcttaagaagggggggctgtatgtgctgggccacgtcaccctgggagacctcgactccctgccctcggaccctgtacagccgcagtatggggcatggctcagcctggtggaccgtgcccaggtgaaggcttttgtggatctaaccctctcaccctccgtgcgccagggggctcagcatctgctgcgaatctccggcctcgagtctgggacgctattaccctggggattcaggtcatgagcttggctgatcagggtgtctggtttgcacaaca

SEQ ID NO: 6160 - DNA, 2379 bp, Homo sapiens
aaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaaagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctgg

SEQ ID NO: 6161 - DNA, 5673 bp, Homo sapiens
attatatgcgtgaaccaccgcgcctgaccatggaatcagtttttcaatctgtgctcgaggtgttgtgttcttaactatcttctactcctttgcaaagataatctttcttaaacatagactttctaatcagttctctagcattgtttcattctgtctttggcatgttttcactttgctgtgctgtacttttacacattctttttaactatagcttcctgctttgctctggatcaggaagctattgaagctgacacccacagagttaaactgagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagttcgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaatacagcaattaatattaagatatcttaatatgaagtgcctggagtcaaatataacattccaaagtagtctgactggaagaactagcacctgcctttcttcaaacaatgcacttctgttaatgcagtgtaaggtaacatgagttgtttttggaaactacatcataatgtgggcttacattctagcacttatcacttaatgacagggatacatttgaggaatgcattgttaggcaattttgtcattatgcaaacatcatagagtgtacttacacaaacctatggtatagcctactacacatctaagttatatggtatagactgtttctccagctatatggtgtagactgtttctcctaggctacaaacctgcacagcatgttactgtattaaatgctgtaggcaattgtaacacaatggtatttttatacttaaacatatctaaacatagaaacggtacaaaaaactttacacattatatagatgtatcaaattattcatatgtgctctgaaaatgtctatatctgttatgtatcaattttttaaaaagtgaatgacataattcatttgaaaaaatgtggacacacaaattggaaaagaggtataaatgcagtattataatctaatgggaccacca

SEQ ID NO: 6162 - DNA, 5428 bp, Homo sapiens
aagctattgaagctgacacccacagagttaaactgagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaaagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcggctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcatgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattacctcatacacaatgaatgaatcagaggacagacacgggaatggcacgactgtgcagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgcccaaactttatatacttcagttttaatgacaagcatttcagaaatataagagcggcagccagaccaaccagtttttccagatatcttgatgtgaacctgaccctactcctttagaagacagcctgttcatttttaaatagctttaacccaaactgttctatgaccattgtttcaagagacattaacacagttctgtaaatagaagtgtctatggacaaataagtttgggaaatgtggcatactgtatccttttcttaacatttgcatattaaagactctgagatatcctgcagtaaagacacaagataccttgtttaaattaacatgtacgctgcagaacattggtttggaaaaaactgttgagcagttcttccttgtaagtgctgagcttcctctctgaaacctcctaccattgttttttttcccctgtagctaacaagaataagtataacagccggccaggcacagtggctcatgcctgtaatcccagcactttgggaggctgagacaggtggatcacctgaggtcaggagttcgagaccagcctggccaacatggtgaaaccgtgtctctactaaaagtacaaaaattagccaggtgtgatggcaggtgcctgtaatcccagctactcgggaggctgaagcagaagaattgcttgaacccgggaggcagaggttgcaatgagccgagatcacgccatcacactctagcctgggggacaagagtgagacttcatctaaaaaaaaaaagaaaagaatatgtataccccctttttcatgtggcagatgtttagctatttggggagaactttcatggctcttccctaatcatcaagtattcaaggtaaagattctcggttcctgtaatggttcctcaccaggcataatttgtccttttaccatcctactttctgtcttctgaaaaacattctttatctgaaatacagcaattaatattaagatatcttaatatgaagtgcctggagtcaaatataacattccaaagtagtctgactggaagaactagcacctgcctttcttcaaacaatgcacttctgttaatgcagtgtaaggtaacatgagttgtttttggaaactacatcataatgtgggcttacattctagcacttatcacttaatgacagggatacatttgaggaatgcattgttaggcaattttgtcattatgcaaacatcatagagtgtacttacacaaacctatggtatagcctactacacatctaagttatatggtatagactgtttctccagctatatggtgtagactgtttctcctaggctacaaacctgcacagcatgttactgtattaaatgctgtaggcaattgtaacacaatggtatttttatacttaaacatatctaaacatagaaacggtacaaaaaactttacacattatatagatgtatcaaattattcatatgtgctctgaaaatgtctatatctgttatgtatcaattttttaaaaagtgaatgacataattcatttgaaaaaatgtggacacacaaattggaaaagaggtataaatgcagtattataatctaatgggaccaccatcacatatttggtctgtcattgactgaaactgcaatatagagtttttcttaacatttgcatattaaagactctgactatatatgg

SEQ ID NO: 6163 - DNA, 2115 bp, Homo sapiens
ggagttgagaattagggaggaggtggtagagtccgggtagtgagcggagggacaggaagggtagggcaagaaagggagaggggacaggagggaagggtgggccaaagcggtgagaaaggagggccagccagttgggtgggggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggttttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacgatcccggaagcctggctcctcctggccaatgttgtggtggtgctgattctggtccctctgaaggaccgcttgatcgaccctttactgctgcggtgcaagctgcttccctctgctctgcagaagatggcgctggggatgttctttggttttacctccgtcattgtggcaggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggtgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacga

SEQ ID NO: 6164 - DNA, 1805 bp, Homo sapiens
gggagagggccgaggcccgggggcaggagtgcagggctctgaggcggggagaggagaggagagaagagccgcggggggcccagcccggagccaggatgcccgcgccgcgcgcccgggagcagccccgcgtgcccggggagcgccagccgctgctgcctcgcggtgcgcggggccctcgacggtggcggcgggcggcgggcgcggccgtgctgctggtggagatgctggagcgcgccgccttcttcggcgtcaccgccaacctcgtgctgtacctcaacagcaccaacttcaactggaccggcgagcaggcgacgcgcgccgcgctggtattcctgggcgcctcctacctgctggcgcccgtgggcggctggctggccgacgtgtacctgggccgctaccgcgcggtcgcgctcagcctgctgctctacctggccgcctcgggcctgctgcccgccaccgccttccccgacggccgcagctccttctgcggagagatgcccgcgtcgccgctgggacctgcctgcccctcggccggctgcccgcgctcctcgcccagcccctactgcgcgcccgtcctctacgcgggcctgctgctactcggcctggccgccagctccgtccggagcaacctcacctccttcggtgccgaccaggtgatggatctcggccgcgacgccacccgccgcttcttcaactggtttactggagcatcaacctgggtgctgtgctgtcgctgctggtggtggcgtttattcagcagaacatcagcttcctgctgggctacagcatccctgtgggctgtgtgggcctggcatttttcatcttcctctttgccacccccgtcttcatcaccaagcccccgatgggcagccaagtgtcctctatgcttaagctcgctctccaaaactgctgcccccagctgtggcaacgacactcggccagagaccgtcaatgtgcccgcgtgctggccgacgagaggtctccccagccaggggcttccccgcaagaggacatcgccaacttccaggtgctggtgaagatcttgcccgtcatggtgaccctggtgccctactggatggtctacttccagatgcagtccacctatgtcctgcagggtcttcacctccacatcccaaacattttcccagccaacccggccaacatctctgtggccctgagagcccagggcagcagctacacggagtcctggagatggagcgcttacactacatccaccacaacgagaccgtgtcccagcagattggggaggtcctgtacaacgcggcaccactgtccatctggtggcagatccctcagtacctgctcattgggatcagtgagatctttgccagcatcccaggcctggagtttgcctactcagaggccccgcgctccatgcagggtgccatcatgggcatcttcttctgcctgtcgggggtgggctcactgttgggctccagcctagtggcactgctgtccttgcccgggggctggctgcactgccccaaggactttgggaacatcaacaattgccggatggacctctacttcttcctgctggctggcattcaggccgtcacggctctcctatttgtctggatcgctggacgctatgagagggcgtcccagggcccagcctcccacagccgtttcagcagggacaggggctgaacaggccctattccagcccccttgcttcactctaccggacagacggcagcagtcccagctctggtttccttctcggtttattctgttagaatgaaatggttcccataaataaggggcatgagcccttcctcacg

SEQ ID NO: 6165 - DNA, 2776 bp, Homo sapiens
aggtgacccggcggcggggcgaggcagctggcggcgtcgcatggagggctctgggggcggtgcgggcgagcgggcgccgctgctgggcgcgcggcgggcggcggcggccgcggcggcggctggggcgttcgcgggccggcgcgcggcgtgcggggccgtgctgctgacggagctgctggagcgcgccgctttctacggcatcacgtccaacctggtgctattcctgaacggggcgccgttctgctgggagggcgcgcaggccagcgaggcgctgctgctcttcatgggcctcacctacctgggctcgccgttcggaggctggctggccgacgcgcggctgggccgggcgcgcgccatcctgctgagcctggcgctctacctgctgggcatgctggccttcccgctgctggccgcgcccgccacgcgagccgcgctctgcggttccgcgcgcctgctcaactgcacggcgcctggtcccgacgccgccgcccgctgctgctcaccggccaccttcgcggggctggtgctggtgggcctgggcgtggccaccgtcaaggccaacatcacgcccttcggcgccgaccaggttaaagatcgaggtccggaagccactaggagattttttaattggttttattggagcattaacctgggagcgatcctgtcgttaggtggcattgcctatattcagcagaacgtcagctttgtcactggttatgcgatccccactgtctgcgtcggccttgcttttgtggtcttcctctgtggccagagcgttttcatcaccaagcctcctgatggcagtgccttcaccgacatgttcaagatactgacgtattcctgctgttcccagaagcgaagtggagagcgccagagtaatggtgaaggcattggagtctttcagcaatcttctaaacaaagtctgtttgattcatgtaagatgtctcatggtgggccatttacagaagagaaagtggaagatgtgaaagctctggtcaagattgtccctgttttcttggctttgataccttactggacagtgtatttccaaatgcagacaacatatgttttacagagtcttcatttgaggattccagaaatttcaaatattacaaccactcctcacacgctccctgcagcctggctgaccatgtttgatgctgtgctcatcctcctgctcatccctctgaaggacaaactggtcgatcccattttgagaagacatggcctgctcccatcctccctgaagaggatcgccgtgggcatgttctttgtcatgtgctcggcctttgctgcaggaattttggagagtaaaaggctgaaccttgttaaagagaaaaccattaatcagaccatcggcaacgtcgtctaccatgctgccgatctgtcgctgtggtggcaggtgccgcagtacttgctgattgggatcagcgagatctttgcaagtatcgcaggcctggaatttgcatactcagctgcccccaagtccatgcagagtgccataatgggcttgttctttttcttctctggcgtcgggtcgttcgtgggttctggactgctggcactggtgtctatcaaagccatcggatggatgagcagtcacacagactttggtaatattaacggctgctatttgaactattacttttttcttctggctgctattcaaggagctaccctcctgcttttcctcattatttctgtgaaatatgaccatcatcgagaccatcagcgatcaagagccaatggcgtgcccaccagcaggagggcctgaccttcctgaggccatgtgcggtttctgaggctgacatgtcagtaactgactggggtgcactgagaacaggcaagactttaaattcccataaaatgtctgacttcactgaaacttgcatgttgcctggattgatttcttctttccctctatccaaaggagcttggtaagtgccttactgcagcgtgtctcctggcacgctgggccctccgggaggagagctgcagatttcgagtatgtcgcttgtcattcaaggtctctgtgaatcctctagctgggttcccttttttacagaaactcacaaatggagattgcaaagtcttggggaactccacgtgttagttggcatcccagtttcttaaacaaatagtatcacctgcttcccatagccatatctcactgtaaaaaaaaaattaataaactgttacttatatttaagaaagtgaggatttttttttttttaaagataaaagcatggtcagatgctgcaaggattttacataaatgccatatttatggtttccttcctgagaacaatcttgctcttgccatgttctttgatttaggctggtagtaaacacatttcatctgctgcttcaaaaagtacttactttttaaaccatcaacattacttttctttcttaaggcaaggcatgcataagagtcatttgagaccatgtgtcccatctcaagccacagagcaactcacggggtacttcacaccttacctagtcagagtgcttatatatagctttattttggtacgattgagactaaagactgatcatggttgtatgtaaggaaaacattcttttgaacagaaatagtgtaattaaaaataattgaaagtgttaaatgtgaacttgagctgtttgaccagtcacatttttgtattgttactgtacgtgtatctggggcttctccgtttgttaatactttttctgtatttgttgctgtatttttggcataactttattataaaaagcatctcaaatgcgaaatcca

SEQ ID NO: 6166 - DNA, 2420 bp, Homo sapiens
gtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaa

SEQ ID NO: 6167 - DNA, 1803 bp, Homo sapiens
atctctgtttaccgagagagcccgtccaagttgggctccatcgctgccctcgctccccttcggggcccccgcccgcctgggaagcagagagaaagccgggcccagcccttcctcacccttcccctccccgcaccgcccggagaggtcgggtaagggggaaggagtgtgcgtgggacggggaacctcgggcctggggatctggctgtccccgtccccgtacctcgcgcggacccgggagttccagccctaggccaggctccggctccctccgccccgcgccatcgcgctcggagtgacgggcccaccccgggcgagcagccagaggctggatctcagggatgccagctccccagcggaagcacaggcgtggaggcttctctcacagatgtttccccaccccgcagacggcgatgaccccccagcccgccggacccccggatgggggctggggctgggtggtggcggccgcagccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctcgctggctttggttgggccctggtgttcgcccccgccctaggcaccctctcgcgttacttctcccgccgtcgagtcttggcggtggggctggcgctcaccggcaacggggcctcctcgctgctcctggcgcccgccttgcagcttcttctcgatactttcggctggcggggcgctctgctcctcctcggcgcgatcaccctccacctcaccccctgtggcgccctgctgctacccctggtccttcctggagaccccccagccccaccgcgtagtcccctagctgccctcggcctgagtctgttcacacgccgggccttctcaatctttgctctaggcacagccctggttgggggcgggtacttcgttccttacgtgcacttggctccccacgctttagaccggggcctggggggatacggagcagcgctggtggtggccgtggctgcgatgggggatgcgggcgcccggctggtctgcgggtggctggcagaccaaggctgggtgcccctcccgcggctgctggccgtattcggggctctgactgggctggggctgtgggtggtggggctggtgcccgtggtgggcggcgaagagagctgggggggtcccctgctggccgcggctgtggcctatgggctgagcgcggggagttacgccccgctggttttcggtgtactccccgggctggtgggcgtcggaggtgtggtgcaggccacagggctggtgatgatgctgatgagcctcggggggctcctgggccctcccctgtcaggcttcctaagggatgagacaggagacttcaccgcctctttcctcctgtctggttctttgatcctctccggcagcttcatctacatagggttgcccagggcgctgccctcctgtggtccagcctcccctccagccacgcctcccccagagacgggggagctgcttcccgctccccaggcagtcttgctgtccccaggaggccctggctccactctggacaccacttgttgattattttcttgtttgagcccctcccccaataaagaatttttatcgggtt

SEQ ID NO: 6168 - DNA, 1779 bp, Homo sapiens
atctctgtttaccgagagagcccgtccaagttgggctccatcgctgccctcgctccccttcggggcccccgcccgcctgggaagcagagagaaagccgggcccagcccttcctcacccttcccctccccgcaccgcccggagaggtcgggtaagggggaaggagtgtgcgtgggacggggaacctcgggcctggggatctggctgtccccgtccccgtacctcgcgcggacccgggagttccagccctaggccaggctccggctccctccgccccgcgccatcgcgctcggagtgacgggcccaccccgggcgagcagccagaggctggatctcagggatgccagctccccagcggaagcacaggcgtggaggcttctctcacagatgtttccccaccccgcagacggcgatgaccccccagcccgccggacccccggatgggggctggggctgggtggtggcggccgcagccttcgcgataaacgggctgtcctacgggctgctgcgctcgctgggccttgccttccctgaccttgccgagcactttgaccgaagcgcccaggacactgcgtggatcagcgccctggccctggccgtgcagcaggcagccagccccgtgggcagcgccctgagcacgcgctggggggcccgccccgtggtgatggttgggggcgtcctcgcctcgctgggcttcgtcttctcggctttcgccagcgatctgctgcatctctacctcggcctgggcctcctcgctggctttggttgggccctggtgttcgcccccgccctaggcaccctctcgcgttacttctcccgccgtcgagtcttggcggtggggctggcgctcaccggcaacggggcctcctcgctgctcctggcgcccgccttgcagcttcttctcgatactttcggctggcggggcgctctgctcctcctcggcgcgatcaccctccacctcaccccctgtggcgccctgctgctacccctggtccttcctggagaccccccagccccaccgcgtagtcccctagctgccctcggcctgagtctgttcacacgccgggccttctcaatctttgctctaggcacagccctggttgggggcgggtacttcgttccttacgtgcacttggctccccacgctttagaccggggcctggggggatacggagcagcgctggtggtggccgtggctgcgatgggggatgcgggcgcccggctggtctgcgggtggctggcagaccaaggctgggtgcccctcccgcggctgctggccgtattcggggctctgactgggctggggctgtgggtggtggggctgagctgggggggtcccctgctggccgcggctgtggcctatgggctgagcgcggggagttacgccccgctggttttcggtgtactccccgggctggtgggcgtcggaggtgtggtgcaggccacagggctggtgatgatgctgatgagcctcggggggctcctgggccctcccctgtcaggcttcctaagggatgagacaggagacttcaccgcctctttcctcctgtctggttctttgatcctctccggcagcttcatctacatagggttgcccagggcgctgccctcctgtggtccagcctcccctccagccacgcctcccccagagacgggggagctgcttcccgctccccaggcagtcttgctgtccccaggaggccctggctccactctggacaccacttgttgattattttcttgtttgagcccctcccccaataaagaatttttatcgggtt

SEQ ID NO: 6169 - DNA, 1663 bp, Homo sapiens
tctggcccggccagcgcgggccaggtcttcagtcctatatcgccccgccttgggaaaaggtgcaggggcctctcgccgcctcgtcgggcccttcctctctacctgcctctccaacccctctcggccccgagccacccggcagcgggggtgggtgtgcagaggtgcggcgtccagaacccggctcctgcagaggctctgggtggcagcagccctgttaccgcttagatggcgcgcaggacagagccccccgacgggggctggggatgggtggtggtgctctcagcgttcttccagtcggcgcttgtgtttggggtgctccgctcctttggggtcttcttcgtggagtttgtggcggcgtttgaggagcaggcagcgcgcgtctcctggatcgcctccataggaatcgcggtgcagcagtttgggagcccggtaggcagtgccctgagcacgaagttcgggcccaggcccgtggtgatgactggaggcatcttggctgcgctggggatgctgctcgcctcttttgctacttccttgacccacctatacctgagtattgggttgctgtcaggctctggctgggctttgaccttcgctccgaccctggcctgcctgtcctgttatttctctcgccgacgatccctggccaccgggctggcactgacaggcgtgggcctctcctccttcacatttgccccctttttccagtggctgctcagccactacgcctggagggggtccctgctgctggtgtctgccctctccctccacctagtggcctgtggtgctctcctccgcccaccctccctggctgaggaccctgctgtgggtggtcccagggcccaactcacctctctcctccatcatggccccttcctccgttacactgttgccctcaccctgatcaacactggctacttcattccctacctccacctggtggcccatctccaggacctggattgggacccactacctgctgccttcctactctcagttgttgctatttctgacctcgtggggcgtgtggtctccggatggctgggagatgcagtcccagggcctgtgacacgactcctgatgctctggaccaccttgactggggtgtcactagccctgttccctgtagctcaggctcccacagccctggtggctctggctgtggcctacggcttcacatcaggggctctggccccactggccttctccgtgctgcctgaactaatagggactagaaggatttactgtggcctgggactgttgcagatgatagagagcatcggggggctgctggggcctcctctctcaggctacctccgggatgtgacaggcaactacacggcttcttttgtggtggctggggccttccttctttcagggagtggcattctcctcaccctgccccacttcttctgcttctcaactactacctccgggccccaggaccttgtaacagaagcactagatactaaagttcccctacccaaggaggggctggaagaggactgaactccacagagtcaggcccagaaagccaaagcttgacagctccaggtcttctcttgccacgtcttggtctccacagaaccacagtgccttaagattcttgatctgcctccccctagagcaggcctggggctcctgcaatgtgtgtgccaaccctttg

SEQ ID NO: 6170 - DNA, 4390 bp, Homo sapiens
agccaaagctataaacttcaaccggccacaagagtgtgcatgtgaggtgactgcattttttttccctgccaaaccagaattagccggtataggaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcagggtggatctatgacatcacgcaaaaatatgatttttccttctacatatgtggtttgctttacatgataggaatactctttttacttattcagccgtgcattcgaattatagaacaatccagaagaaaatacatggatggtgcacatgtttagtatcatgtaatgttccgtgtaggtttcattgtaatactcatgcctacctcgcatggttgctgtgaggcacctatgacaggacgtgggaaagcattttgtacggtaactggcactgtcatttgtaaatgccattgtcacagcctcatttgtaagcagcactgcctctctgtttggggagatgtaatgctggaagatcttaaggactacatacattctagagatgacagtgttgttcaaagacagcctagtaagtaattggtagaaatgcccttataaaaaccattctcttgtcatctactgggactagggttttaaatacagcttttaaaaacaaaaacagggaataaaagcttttcaactcaaccacttctttgtaagacaaaactgaagtatctgtgtgcttccagaaagcttacagataaatgggtttcaagcacaagaatatgactagatttcagaaattaattattacagggagctattgatctactagcatcaaacaaaggcaagctctaattccacaggtaatacaatttagtgcaattaaagaaacacggcttgtatttttatgagggaattctgcagctagggattgtgactcctaaatcctcctctaaaagaaggcacttgccattaatcctaattcagtgctatccagttataaatggaatcttgagacaaaaccttaacaaagaaataacagtaatgatttccttagcagaagccgtatttgtacgcacaacattaaatcaagggctacaattcaagcacttttattcgtatcattggcctcttagatgatataagcatgaggtggggcctgtaatatttttttctgagtttcttctgcccaaaaatataatatagaactaattgctaactgacaaataaagttaatagttaaatcatctccaaggaatgttgctaatccaaagtataacactatcaatttgtgaggataataaatggaatgccattagtgtagatgtctgtgccacatctgacactggagtagtgataacaaatagcccatctctagactctcgtgttgttatatagaccattcatttgcctgagcgtggcacagttttaaaaatagttctcttgattgatttcatacagaagatgactgtgatccatgacatctaataatgccctttctttatctgagatgtctatttttctaagccaaacgtttttcagactgcagaatgttcttcccagatcatttgaaatttctggctgccttacttgtttacagatagtttaagactatttaaatttctactcacaatttgatcatcacacacacacaaatccttgaatatcattgccagtgtcttaggtcaaatttacctaaagtgaatacagcccattctcaattatccttcacaattagacgcaggaatgctactaggaattggaatcaaacaatgccaccccaagcgtaattttagccagcagtttcagttatactcaaccatgcccttctgagctgttaacaagtgattcaatggacaagttctctttttgttccatctccattatttcctgctctaatgtatagtgggagtggttgtgtaatgaaaggaccaccaaaataataaaaggcagctaatggaaaggagagacaaaagcatggttaatatatatacttaatattacctccaatgactcgggaattgcctgtaaattattatagacaatagattgcatgtcatactccatttggttcaacacaacaacctatgtgttatcattacagctttggctgctgttaaagaatccagctctctattttgataaagataatcttaaagctgaggcaatgctccctcctctatctctctctgtgtaatttaccatagaattaggatgattagattgaaacacatgttgtatgttttaaaaactacattgcttcattactttcattttccgacaacatcaaactaacaagaggcagtgttaaatattttaaatggtgctatagccaatgtatttgaatgcttgcactgctggttgtgtatcatcaatatgaactttttatccaatgactcaactctaattacatctaagttagacttgctcacgttcagtttgtacagttgtgtgttgacttactatgttttgaaagtggtgacttctaccgaatgagtggaagttcccattgtcaaaaaaaataaagacctgcttgcagtattcatgttgacaacagagtaaaagagaatactgtaaagaattactgcaaatatttcctgtttatgttatttgccgttgtttgaagatattataaagggttaattgtatatttatatcatgtgctttatcgttttcccctcatgtatccaagtaatttttatttacatacaactaaataaatgttgtcctctttgaa

SEQ ID NO: 6171 - DNA, 1672 bp, Homo sapiens
atccgaggccgcgcgcgccgcgggcctggggaatggagcgacgccgggggcatcggagcctagctcagctcagctccgctccccagccttctccgcggcagcctcttcagcctgctggccgcaagtgcgccctctaaaggccccaaatgccctgtacacaccaggtgaagagcgcggaagcgcctgcagagcagaattaaagaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcaggtaaactctctgaggttttaagagctcagagtgcatgtacatatggtgcgttatgttataaagtcccagataaag

SEQ ID NO: 6172 - DNA, 537 bp, Homo sapiens
gcttggggacgcgcgccttgctgctcaagctggccggggccccgcgagcgtcatcctgggcacccccgtccggctggagaagcgcgttctgcccggagcccagcctcgctgcccggctgctctctaggcccgtttgggactcgaactggacagtgatgaggcgcagagcgggggacccggggctgcgcctagggacttcgcggggtgcggatgcctctctgcacaggctgtggtgctgcagccggcccagcttccccgctcagctcagctccgctccccagccttctccgcggcagcctcttcagcctgctggccgcaagtgcgccctctaaaggccccaaatgccctgtacacaccaggtgaagagcgcggaagcgcctgcagagcagaattaaagaaaaatcttggaaaatgtataccagtcatgaagatattgggtatgattttgaagatggccccaaagacaaaaagacactgaagccccacccaaacattgatggcggatgggcttggatgatggtgctctcctctttcttt

SEQ ID NO: 6173 - DNA, 646 bp, Homo sapiens
agctataaacttcaaccggccacaagagtgtgcatgtgaggtgactgcattttttttccctgccaaaccagaattagccggtataggaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgctcagctcagctccgctccccagccttctccgcggcagcctcttcagcctgctggccgcaagtgcgccctctaaaggccccaaatgccctgtacacaccaggtgaagagcgcggaagcgcctgcagagcagaattaaagaaaaatcttggaaaatgtataccagtcatgaagatattgggtatgattttgaagatggccccaaagac

SEQ ID NO: 6174 - DNA, 1836 bp, Homo sapiens
gaatgaacgagcatgaagatttgaaattgctccgattggaaggaagcccaggttaggtttgggcacctccaaacgcacccgttttaaagccacctggactgaggcgtcgagctttcagctccaccaaacgctcacctggcctggcagcgagcggcggaagagcccgggagcccctcacagagcgcaccgagccgggcggagagctgagccgcaggcacccgcgtctccaggatgataggcgacattgcaacaaatctctacacccagcagctcagggggctccaagcagagcagcaagttcgaggatccgggcgtggagccgagtgaggccgcagcccagcgggcctcgggcgaaaaatcttggaaaatgtataccagtcatgaagatattgggtatgattttgaagatggccccaaagacaaaaagacactgaagccccacccaaacattgatggcggatgggcttggatgatggtgctctcctctttctttgtgcacatcctcatcatgggctcccagatggccctgggtgtcctcaacgtggaatggctggaagaattccaccagagccgcggcctgaccgcctgggtcagctccctcagcatgggcatcaccttgatagtgggccctttcatcggcttgttcattaacacctgtgggtgccgccagactgcgatcattggagggctcgtcaactccctgggctgggtgttgagtgcctatgctgcaaacgtgcattatctcttcattacttttggagtcgcagctggcctgggcagcgggatggcctacctgccagcggtggtcatggtgggcaggtatttccagaagagacgcgccctcgcccagggcctcagcaccacggggaccggattcggtacgttcctaatgactgtgctgctgaagtacctgtgcgcagagtacggctggaggaatgccatgttgatccaaggtgccgtttccctaaacctgtgtgtttgtggggcgctcatgaggcccctctctcctggtaaaaacccaaacgacccaggagagaaagatgtgcgtggcctgccagcgcactccacagaatctgtgaagtcaactggacagcagggaagaacagaagagaaggatggtgggctcgggaacgaggagaccctctgcgacctgcaagcccaggagtgccccgatcaggccgggcacaggaagaacatgtgtgccctccggattctgaagactgtcagctggctcaccatgagagtcaggaagggcttcgaggactggtattcgggctactttgggacagcctctctatttacaaatcgaatgtttgtagcctttattttctgggctttgtttgcatacagcagctttgtcatccccttcattcacctcccagaaatcgtcaatttgtataacttatcggagcaaaacgacgttttccctctgacgtcaattatagcaatagttcacatctttggaaaagtgatcctgggcgtcatagccgacttgccttgcattagtgtttggaatgtcttcctgttggccaacttcacccttgtcctcagtatttttattctgccgttgatgcacacgtacgctggcctggcggtcatctgtgcgctgatagggttttccagtggttatttctccctaatgcccgtagtgactgaagacttggttggcattgaacacctggccaatgcctacggcatcatcatctgtgctaatggcatctctgcattgctgggaccaccttttgcaggtaaactctctgaggttttaagagctcagagtgcatgtacatatggtgcgttatgttataaagtcccagataaagaagaaggtttcca

SEQ ID NO: 6175 - DNA, 2632 bp, Homo sapiens
acagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaattgctttaaaaa

SEQ ID NO: 6176 - DNA, 2082 bp, Homo sapiens
cactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtgaatgtgtttgtgatggggatgaccaagacttttgcaattttctttgtggtctttcaagaagagtttgaaggcacctcagagcaaattggttggattggatccatcatgtcatctcttcgtttttgtgcaggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaatttttttttttttttttttgagacggagtctcgctctttcgcccaggctggagtgcagtggcgcaatctcggctcactgtaatctccgcctcctgggttcaagggattctcctgcctcagcctcccaagtagctgggactacaggcacacgccaccacacccagctaattttttgtatttttagtagaggcggggtttcaccatgttagccaggatggtctccatctcctgacctcgtgatccgcccgccttgtcctccaaagtgctgggattacaggcatgagccactgggcgcggccagataagtttttaaggttccttcttgctttagcattctgagaaatgtctaattggtagtaagacaagagtaatagcaacctgtattgttagtatttaaccaaataggctaaaattttaatcaggtaccttatgtattaaatagaaatcggaatgtaccataataaatccaaactctcaattacgccatggtaattcagtcactaaaatatgtaaagatagaaaattttttaatttaaagaagtgtgaaacatagccattgattgatcagaattctggaatctgaatattaaaaccttacttagtgactggaatggtatatgctccctccaaaagtttatctttgtttattgattaaaggtaatccttactttctttgtattacttaggttcttaattaaaggtaatccttactttctttgtattacttaggttcttaaatttctatgataaacatgtattgctaaataataaaaagtatataaaaa

SEQ ID NO: 6177 - DNA, 1541 bp, Homo sapiens
gtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcagaaatcattccttccttccaggctggttatatgattatacccagacatacaatggctctttctacttctctggcatatgctatctcctctcttcagtttcctttttttttgtaccattggccgaaagatggaaaaacagtctgacctgaaagaaagaagactgcaatcaagtgagagctaaacaaaagaaaacctaaactaatgtcattggaaacaaaagcttgaaagaaacacatcgcatctacatttgtaacatgagaaggaaaacaattttttttttttttttttt

SEQ ID NO: 6178 - DNA, 1551 bp, Homo sapiens
cactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgctgaagagggaggggaaggtccaaccttacactaaaaccctggatggaggatggggatggatgattgtgattcattttttcctggtcccctggttgctattatttgtgacatacttggagagaaaactacctccattcttggggctttcgttgttactggtggatatctgatcagcagctgggccacaagtattccttttctttgtgtgactatgggacttctacccggtttgggttctgctttcttataccaagtggctgctgtggtaactaccaaatacttcaaaaaacgattggctctttctacagctattgcccgttctgggatgggactgacttttcttttggcaccctttacaaaattcctgatagatctgtatgactggacaggagcccttatattatttggagctatcgcattgaatttggtgccttctagtatgctcttaagacccatccatatcaaaagtgagaacaattctggtattaaagataaaggcagcagtttgtctgcacatggtccagaggcacatgcaacagaaacacactgccatgagacagaagagtctaccatcaaggacagtactacgcagaaggctggactacctagcaaaaatttaacagtctcacaaaatcaaagtgaagagttctacaatgggcctaacaggaacagactgttattaaagagtgatgaagaaagtgataaggttatttcgtggagctgcaaacaactgtttgacatttctctctttagaaatcctttcttctacatatttacttggtcttttctcctcagtcagttagcatacttcatccctacctttcacctggtagccagagccaaaacactggggattgacatcatggatgcctcttaccttgtttctgtagcaggtatccttgagacggtcagtcagattatttctggatgggttgctgatcaaaactggattaagaagtatcattaccacaagtcttacctcatcctctgcggcatcactaacctgcttgctcctttagccaccacatttccactacttatgacctacaccatctgctttgccatctttgctggtggttacctggcattgatactgcctgtactggttgatctgtgtaggaattctacagtaaacaggtttttgggacttgccagtttctttgctgggatggctgtcctttctggaccacctatagcaggctggttatatgattatacccagacatacaatggctctttctacttctctggcatatgctatctcctctcttcagtttcctttttttttgtaccattggccgaaagatggaaaaacagtctgacctgaaaga

SEQ ID NO: 6179 - DNA, 1923 bp, Homo sapiens
gcggtcctcgtcgcgaccggcccgggccgcaggacgccgcgctcgggggagctgagccacctctccgccaggcccgtgcgagcggtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttt

SEQ ID NO: 6180 - DNA, 2051 bp, Homo sapiens
gtctaaacttctccctgcccacacatccagcttcatggcactgtgctacaaagctggtctcattgggcctaggggtctttgagagctgagcttggcagcccctggggcccaacctcacccctagtcccagcaagtgagagcgaagcatcttgccctgtctacctccttgcccaaagcacacaccaggcagtgaccatgactcatggttcccagtacaaagaaaagagcacttccctgctggggcagaggccaagccagagccctggccccatcacctctctgccctgcttgagtctggaatggacctccctgcctggaagctgcattgcccttggtcctgggcctgcctgccccctggggaacacaggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtgccagtcttcccgccagccacgtccagctggcgtcaataagcatctttggggatgtcctgcctcctccaggaccagccatgagtggctcttatggccaaaggcggtactgcaggccaagcaaacggctctgggctggaatagccctacctgagtgccctgtttgactccgccactatctgccatgtgagttgggcaaattgttgaccacctctgagccttgaaaaagtaggaggttactttgttagagcaaaataataaaatttaatttt

SEQ ID NO: 6181 - DNA, 1726 bp, Homo sapiens
gggtgaaaggagatgccaaggccaacgcgtgggcctctggccacctcccaggggtggtgcccctctgtgacacctggtacttgggcagcagccacattggcagtgaggccgtggcagcgtcggcagcagaggatgccccaggccctggagcgtgcagatggcagctgggcctgggtggtgctgctggccaccatggtgacccagggcctcaccctgggcttccccacgtgtatcggcatcttcttcactgaattgcaatgggagttccaggccagcaacagcgagacctcttggttcccctccatcctcacggctgtgctccacatggcagggcccctgtgcagcatcctggtgggacgcttcggctgccgagtgaccgtgatgctggggggcgtgctggccagcctgggcatggtggccagctccttctctcacaacctcagccagctctacttcacagcaggattcatcacaggcctgggcatgtgcttcagcttccagtcaagcatcacggtgctgggcttctactttgtccgccggcgggtgctggccaacgcgctggcctcgatgggcgtctccctgggcatcaccctctggccgctgctctcccgctaccttctggagaacctgggctggaggggtaccttccttgtcttcggcgggatctttctccactgctgcatctgcggggccatcataaggcctgtggccaccagtgtggcccctgagaccaaagaatgtcccccgccacctcccgagacacctgcacttggctgcctggctgcatgcggccggaccatccagcgccacctggccttcgacatcctgcggcacaacacaggctactgcgtgtacatactgggtgtgatgtggtccgtcctgggcttcccactgccacaagtcttcctggtgccatatgccatgtggcacagcgtggacgagcagcaggcagccctcctcatctccatcatcggcttcagcaacatcttcctgaggcccctagccgggctgatggcaggacggccggcctttgctagccaccgcaagtacctgttcagcctggcactcctgctcaatgggctcactaacctggtgtgtgcggcatcaggtgacttctgggtgctcgtgggctactgcctggcgtacagcgtgtccatgagtggcatcggcgccctcatcttccaggttctcatggacatcgtccccatggatcagttccccagagccctgggactcttcactgtcctggacggccttgctttcctcatctccccaccactggccgggttgctcctggacgccaccaacaactttagctatgttttctacatgtccagcttcttcctcatctcagctgccctcttcatgggtggcagcttctacgccctgcagaagaaggagcaaggcaagcaggctgtcgcggcggatgccctggagcgggatcttttcttggaagccaaagacggtcctgggaagcaacggtcccctgagatcatgtatgtaaccagcgtctaagacccagggttcatctgtgtgaccagtgtctgagtcctgggatcactgagtgaacactgtctcagcccagcccaggagggggacctctagctccttcaccaggggcttgggtgaagagtagcccaggaagcccgggctgtccaggctctgcaagctgggactctgccaggagctgggactttggaggctggcctctgaagatgccctgaga

SEQ ID NO: 6182 - DNA, 3828 bp, Homo sapiens
gggtggagggcccgggcgctcgggcctcaccagcccgagccaacttgcgctagagtcgggcccgccccctaaggggttaatccttttctcatgttaccgagcggcttataaggagggggaggccaagcctccgccttattgggagcctttgggggtttattctcttcccttctaacttgattaagaatgacccaaaataaattaaagctttgttccaaagccaatgtgtatactgaagtgcctgatggaggatggggctgggcggtagctgtttcatttttcttcgttgaagtcttcacctacggcatcatcaagacatttggtgtcttctttaatgacttaatggacagttttaatgaatccaatagcaggatctcatggataatctcaatctgtgtgtttgtcttaacattttcagctcccctcgccacagtcctgagcaatcgtttcggacaccgtctggtagtgatgttgggggggctacttgtcagcaccgggatggtggccgcctccttctcacaagaggtttctcatatgtacgtcgccatcggcatcatctctggtctgggatactgctttagttttctcccaactgtaaccatcctatcacaatattttggcaaaagacgttccatagtcactgcagttgcttccacaggagaatgtttcgctgtgtttgctttcgcaccagcaatcatggctctgaaggagcgcattggctggagatacagcctcctcttcgtgggcctactacagttaaacattgtcatcttcggagcactgctcagacccatctttatcagaggaccagcgtcaccgaaaatagtcatccaggaaaatcggaaagaagcgcagtatatgcttgaaaatgagaaaacacgaacctcaatagactccattgactcaggagtagaactaactacctcacctaaaaatgtgcctactcacactaacctggaactggagccgaaggccgacatgcagcaggtcctggtgaagaccagccccaggccaagcgaaaagaaagccccgctattagacttctccattttgaaagagaaaagttttatttgttatgcattatttggtctctttgcaacactgggattctttgcaccttccttgtacatcattcctctgggcattagtctgggcattgaccaggaccgcgctgcttttttattatctacgatggccattgcagaagttttcggaaggatcggagctggttttgtcctcaacagggagcccattcgtaagatttacattgagctcatctgcgtcatcttattgactgtgtctctgtttgcctttacttttgctactgaattctggggtctaatgtcatgcagcatattttttgggtttatggttggaacaataggagggactcacattccactgcttgctgaggatgatgtcgtgggcattgagaagatgtcttctgcagctggggtctacatcttcattcagagcatagcaggactggctggaccgccccttgcaggtttgttggtggaccaaagtaagatctacagcagggccttctactcctgcgcagctggcatggccctggctgctgtgtgcctcgccctggtgagaccgtgtaagatgggactgtgccagcatcatcactcaggtgaaacaaaggtagtgagccatcgtgggaagactttacaggacatacctgaagactttctggaaatggatcttgcaaaaaatgagcacagagttcacgtgcaaatggagccggtatgacacactttcttacaacaacagccactgtgttggctggagagggatggggtgggcccaacggggacacaaggaggcagaggagctaacccctctactccactttcaaaactacattttaaagggaatgtgtatgtgaagagcactaccaacatcgcttttgttttgttttgttttgttttaagctttttttttttgcttgtttttaaagccaaaacaaaaaacaaccaagcactcttccatatataaatctggctgtattcagtagcaatacaagagatatgtagaaagactctttggttcacattccgatattaaaatagtgacatgaactggcaaagtggttttaaaagctttcacgtgggataaatgattttctttttttcttttctttcttcctatggtcttgtctgaataaactactctcctgaataaaacaacatccaacccaggtcattgaaatgaaattggccagtcaaaaaaaaaaagacttcaatcatttttaaaattcctaattttcagaaatatgaataaatagtttttgttaaaccctttgtaaaataccaaggttcccgttaacaaattacggcctctgcttgctggaaatgaaatatagtttaagaccaaacattttactaataaacaaattttaagtatatatatatatatataacttgaacttcataaatgtgaagattaccacttctttttatggccagtccttatcagaagtgtttcagtacagaatatacaaaatggcatttaaaaatgtgtttcctgttgcttttagttatacagaaatatgtgactgtagtgtctttaatttaaaccgctatttattattaagttattctaggatgattaaagtaatcaaaagaaataaaatctgagacataagcagcatttttacctcctttctgcaatcctttaaatgcctcacagaatacgtcttatcttgtaaaaatactttcataaaaggccaagttgtcatgattcttccatttgattaggggcaacgtgtgctattaaaggggaaaaaataatggattgcaaatcgccttagctttcaaaactaatttgttttatcatttaagaatacttgaggaacttctttgatcagaattatatttcagagaattgttaaagcatttctgatttaaagaaaaaaccatctaattattgaagcatttctgtatttcacatgggggtaacagagacaattatgttatagcgagttacaagttgcaatttacatcttctataacacatgacttgattggtctaagttgccagaggtatcgggtaactggtcattgttttgttttgtttgttttattcttcctttttttttggagtcacactacatgtatagtattgctcacgttagcagttttctgtaaggagggcaagtgtcaggataataggtggactttttactcacctattttaccacaatctcaccctgcaggtgatggtcaatgcttgctgctccatctttattcatcgttaatgttaatttatgacaactcagggggaaaaacataacaagcctagtttggttacaggtacacacaagcttgaatatttctctgcactgaaatgaaagtggcatagttcatcaccacctgctacattttgtagagcatcttatcagccatagaaataggacaatctataaaactttggggagggtgggggaggaaatgacaaagtgtctgtcaaaaacaggcataatctaaaacaaggtggatgtagcaaatctctgtcactgcttgagaactttgagcttgtggcagttttgcagacttacatgacttcagcactttacgacatattttttactatgaatgttcaatacaatttaatatttataactgatttctgagggatctgctccatgtctattctgttatctgcatgaaaacaaaatgtatgccaatttcagtatgtcaataatcaaggttttaaatgtttggaagaaaatacaaacaagattgctgatctgttctgtattagtgacattctggtacttctagatttgcaataaatttatggattttttatttaaagaga

SEQ ID NO: 6183 - DNA, 1878 bp, Homo sapiens
cagttgtccttcagagggagcctgcagaggtgcagagtcaggtgggacccgtcgtcctcccctcgtccttcagcgccctttgcaggagaaggagacttgggaggcagcgatgggcgctggcggcccccggcggggcgagggccccccagacggcggctggggctgggtggtgctgggcgcctgctttgtggtcaccggcttcgcctacggcttccccaaagccgtgagcgtcttcttccgcgcgctcatgcgcgacttcgacgccggctacagcgacacggcctgggtgtcctccatcatgctagccatgctctacggcacgggccccgtgtccagcatcctcgtgacccgctttggctgtcgcccggtgatgctggcgggtgggctgctggcttccgcgggcatgatcctagcttcctttgccacgcgcctcctggagctctacctgaccgctggggtgctcacaggcctgggcctggccctcaacttccagccgtcgctcatcatgctggggctgtacttcgagcggcggcggcctctggccaacgggctggcggcggcgggcagccccgtgttcctgtccgcgctgtcgccgctcggccagcagctgctggagcgcttcggctggcgcggcggcttcctgctgctcggcgggctcctgctgcactgctgcgcctgcggggctgtcatgaggccgccgcccgggccgggcccgcgaccgcgcagggacagcgccggcgaccgcgccggggacgctccgggcgaggcggaggctgacggtgcggggctgcagctgcgcgaggcatcccccagggtccggccccgccggcgcctgctggacttggcagtgtgcaccgaccgcgccttcgccgtgtacgccgtcaccaagttcctgatggcgctcgggctcttcgtccccgccatcctgctggtgaactacgccaaggacgcgggcgtgcccgacaccgacgccgccttcctgctgtccatcgtgggcttcgtggacatcgtggcgcgcccggcgtgcggcgccctggcgggcctggcgcgtctgcggccgcacgtcccgtatctgttcagcctggccctgctggccaatgggctcacagacctgagcagcgcacgcgcgcgctcctacggcgccctcgtcgccttctgcgtcgccttcggcctctcctacggcatggtgggcgcgctgcagttcgaggtgctcatggcggctgtgggcgcgccccgcttccccagtgcgctgggcctggtgttgctcgtggaggccgcggctgtgctcatcggaccgccctctgccggccgcctggtggatgtgttgaagaactatgagatcatcttctacctggccggctctgaggtggccctggctggggtcttcatggctgtcgccaccaactgctgcctgcgttgtgctaaagctgccccgtcaggcccaggcactgagggcggagccagtgacactgaggacgctgaggctgaaggggactctgagcccctgcctgttgttgcagaggaacccggcaacctggaggccctggaggtgctcagcgcccggggcgagcccacagaaccagaaatagaggcgaggccgaggctggctgccgagtctgtataactcagggtgctctgggtggggtggcccagtgacttgggaacacagcttcttgtctcagagagcctggtacgctgggaggctggtctggggtggtcactcccggggtccacgtctgggctccagttgatcccctgggtgtctgggaactgcctccctcatctgtgccccaagttccgccaggccctgccccatcgccagtgaagctgctatggagcaacaggaaactggtgataaagctcagctgaacgacagaa

SEQ ID NO: 6184 - DNA, 726 bp, Homo sapiens
gcagcccccatccgggtaagcttcaccgggagctgcggcggcggcccctccctgcaggcctcaggagatgtgaggctggacccccaaacccacgaggcaggctcagtcatttgtgatcactgagaaacattaggaacatggcggaaggctaaagaggaaaatcacgcacagcggccctttgcagccggcatctgcccctctgctgtttgttctgttgtcccgagaccctcacgcgtacggggcgactttggtgctggacgcccacctccaggcacatacctgctccacttcccgacgccttccacctgaggccctgaggggccagcagttgtccttcagagggagcctgcagaggtgcagagtcaggtgggacccgtcgtcctcccctcgtccttcagcgccctttgcaggagaaggagacttgggaggcagcgatgggcgctggcggcccccggcggggcgagggccccccagacggcggctggggctgggtggtgctgggcgcctgctttgtggtcaccggcttcgcctacggcttccccaaagccgtgagcgtcttcttccgcgcgctcatgcgcgacttcgacgccggctacagcgacacggcctgggtgtcctccatcatgctagccatgctctacggcacgggccccgtgtccagcatcctcgtgacccgctttggctgtcgcccggtgatgctggcgggtgggctgctggcttccgcgg

SEQ ID NO: 6185 - DNA, 1555 bp, Homo sapiens
tgggacagcaagacctccgctcaggcccctctttcgaatgctccacgccctcctgcgatctagaatgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccag

SEQ ID NO: 6186 - DNA, 2446 bp, Homo sapiens
ctatgtttctgtgaccacaaatagcatctttggcaagtctagtttcagttggtctttgtccagctcctggattcctccatgcagggcctgagaagccctgagggataaaagattaatccggttcagtggactctgtggttcctcaactccaagtgcccccagcataagtcggacctgcctctcacgcaatggatcccctggcggcaacccgagaccggttctcctacccgcattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctacc

SEQ ID NO: 6187 - DNA, 2388 bp, Homo sapiens
cggacctgcctctcacgcaatggatcccctggcggcaacccgagaccggttctcctacccgcattccgccaagtctctcgctctgcccaggacgcacagatgagagcgctccgaagactgagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagttgtgtggtaatcgagagggtgggtcggcgcgtgctgctcatcggtgggtacagcctgatgacctgctgggggagcatcttcactgtggccctgtgcctgcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtgcttagcaatcaatggtgagcgtggtattccaggctaaaggtaattaactgacagaaaatcagtaacaacataattacaggctggttgtggcagctcatgactgtaatcccagcactttgggaggccaaggtgggaggatcaattgaggccagagtttgaaaccagcctaggtaacatagtgagaccccctatctctacaaaaaattttaaacattagctgggcatggtggtatgtgctaacagctctagctactcaggaggctgaggcagcaggatcacttgagtccaagagttcaaggtagcagtaagctacaatcacaccactgcatgccagactgggtgacagagggagacttcatctctttaaaacataataataataattacagactcaggaaatgcagtgaaagaaaaatacaggttggccaggtgaggtggctgatgcctgtaatcccagcactttgggaggccaagatgggaagattgctttgagaccagaagtttgagaccagcctgggccacatagtaagatcctgtttctacc

SEQ ID NO: 6188 - DNA, 1290 bp, Homo sapiens
cggacctgcctctcacgcaatggatcccctggcggcaacccgagaccggttctcctacccgcattccgccaagtctctcgctctgcccaggacgcacagatgagagcgctccgaagactgagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccagaaaaagaaaaaa

SEQ ID NO: 6189 - DNA, 1203 bp, Homo sapiens
cggacctgcctctcacgcaatggatcccctggcggcaacccgagaccggttctcctacccgcattccgccaagtctctcgctctgcccaggacgcacagatgagagcgctccgaagactgattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagcactacggcggctccggggctccggggacttggcaggggagctggaggagctggaggaggagcgcgctgcctgccagggctgccgtgccgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtgagtctggagggtgcccttcctccaccagccctgtggggagggacccccaggtcctctgcattaaaccagtttacactccagcttatggtgttaaaatgcagtgaggggccaggtgcggtggctcatgcctgtaagcccagcactttgggaggccgaggtgggtggatcacaaggtcaggagttcgagaccagcctggccaacacagtgaaacccccgtctctactaaaaaatacaaaaaattatcccggcgtggtggcgggcgcctgtaa

SEQ ID NO: 6190 - DNA, 2143 bp, Homo sapiens
atctttcggtctttcctaattttcccgtcctctggggaaaggtcggggatacctgaaccaaagtgtgtgtgtgtgggggggggggggtgtaggtggggcgtgcatagatgtgcacaaccaagggcttggccctccggagaacgcccaggggcagtggcctccgaggttctggcggccggcagtggcgaccggcgcagggaatcgcgcagggttgcggctgaggtcagaccagcgagagacagagacccgcagacatttagtccagagactgtagcaaaggagggggacgaggggccagagccggaatttcgggggaggacttgggagcgcggcgaccagagtcgcttgctggcacttgcgagggcgaatgcaggggcttggccgagatgaccttggaccagagctcccttccggcctgcagagatgagcttggggcttagccgagtaaggagtgagcggcttttcagcctcagtgctgcggcagaggcggatggaggatgaactggagccgtccttacggcctcggacgcagattcagggcaggatcctgctcctgaccatctgcgctgccggcattggtgggacttttcagtttggctataacctctctatcatcaatgccccgaccttgcacattcaggaattcaccaatgagacatggcaggcgcgtactggagagccactgcccgatcacctagtcctgcttatgtggtccctcatcgtgtctctgtatcccctgggaggcctctttggagcactgcttgcaggtcccttggccatcacgctgggaaggaagaagtccctcctggtgaataacatctttgtggtgtcagcagcaatcctgtttggattcagccgcaaagcaggctcctttgagatgatcatgctgggaagactgctcgtgggagtcaatgcaggtgtgagcatgaacatccagcccatgtacctgggggagagcgcccctaaggagctccgaggagctgtggccatgagctcagccatctttacggctctggggatcgtgatgggacaggtggtcggactcagggagctcctaggtggccctcaggcctggcccctgctgctggccagctgcctggtgcccggggcgctccagctcgcctccctgcctctgctccctgaaagcccgcgctacctcctcattgactgtggagacaccgaggcctgcctggcagcactacggcggctccggggctccggggacttggcaggggagctggaggagctggaggaggagcgcgctgcctgccagggctgccgtgcccggcgcccatgggagctgttccagcatcgggccctgaggagacaggtgacaagcctcgtggttctgggcagtgccatggagctctgcgggaatgactcggtgtacgcctacgcctcctccgtgttccggaaggcaggagtgccggaagcgaagatccagtacgcgatcatcgggactgggagctgcgagctgctcacggcggttgttagtgtagctggggtggatgagggctggggggtccaggccgggctgacttccacctcacccccgccccgtccacggcagagctccttcccctggacactctacctggccatggcctgcatctttgccttcatcctcagctttggcattggccctgccggagtgacggggatcctggccacagagctgtttgaccagatggccaggcctgctgcctgcatggtctgcggggcgctcatgtggatcatgctcatcctggtcggcctgggatttccctttatcatggtcttggggtcttttttaatcgcaggaggccttgtcccacttcctctatgtccctttccttggtgtctgtgtctgtggggccatctacactggcctgttccttcctgagaccaaaggcaagaccttccaagagatctccaaggaattacacagactcaacttccccaggcgggcccagggccccacgtggaggagcctggaggttatccagtcaacagaactctagtcccaaaggggtggccagagccaaagccagctactgtcctgtcctctgcttcctgccagggccctggtcctcactccctcctgcattcctcatttaaggagtgtttattgagcaccctttgtgtgcagacatggctccaggtg

SEQ ID NO: 6191 - DNA, 4468 bp, Homo sapiens
agaaacaaagttggtcacaaatcacattagctttgcccgaagtttttccccacactcttctttagcatgctattatggggaaagtgaccactcctgggagcgggggtggtcggggcggtttggtggcggggaagcggctgtaacttctacgtgaccatggtacctgttgaaaacaccgagggccccagtctgctgaaccagaaggggacagccgtggagacggagggcagcggcagccggcatcctccctgggcgagaggctgcggcatgtttaccttcctgtcatctgtcactgctgctgtcagtggcctcctggtgggttatgaacttgggatcatctctggggctcttcttcagatcaaaaccttattagccctgagctgccatgagcaggaaatggttgtgagctccctcgtcattggagccctccttgcctcactcaccggaggggtcctgatagacagatatggaagaaggacagcaatcatcttgtcatcctgcctgcttggactcggaagcttagtcttgatcctcagtttatcctacacggttcttatagtgggacgcattgccataggggtctccatctccctctcttccattgccacttgtgtttacatcgcagagattgctcctcaacacagaagaggccttcttgtgtcactgaatgagctgatgattgtcatcggcattctttctgcctatatttcaaattacgcatttgccaatgttttccatggctggaagtacatgtttggtcttgtgattcccttgggagttttgcaagcaattgcaatgtattttcttcctccaagccctcggtttctggtgatgaaaggacaagagggagctgctagcaaggttcttggaaggttaagagcactctcagatacaactgaggaactcactgtgatcaaatcctccctgaaagatgaatatcagtacagtttttgggatctgtttcgttcaaaagacaacatgcggacccgaataatgataggactaacactagtattttttgtacaaatcactggccaaccaaacatattgttctatgcatcaactgttttgaagtcagttggatttcaaagcaatgaggcagctagcctcgcctccactggggttggagtcgtcaaggtcattagcaccatccctgccactcttcttgtagaccatgtcggcagcaaaacattcctctgcattggctcctctgtgatggcagcttcgttggtgaccatgggcatcgtaaatctcaacatccacatgaacttcacccatatctgcagaagccacaattctatcaaccagtccttggatgagtctgtgatttatggaccaggaaacctgtcaaccaacaacaatactctcagagaccacttcaaagggatttcttcccatagcagaagctcactcatgcccctgagaaatgatgtggataagagaggggagacgacctcagcatccttgctaaatgctggattaagccacactgaataccagatagtcacagaccctggggacgtcccagcttttttgaaatggctgtccttagccagcttgcttgtttatgttgctgctttttcaattggtctaggaccaatgccctggctggtgctcagcgagatctttcctggtgggatcagaggacgagccatggctttaacttctagcatgaactggggcatcaatctcctcatctcgctgacatttttgactgtaactgatcttattggcctgccatgggtgtgctttatatatacaatcatgagtctagcatccctgctttttgttgttatgtttatacctgagacaaagggatgctctttggaacaaatatcaatggagctagcaaaagtgaactatgtgaaaaacaacatttgttttatgagtcatcaccaagaagaattagtgccaaaacagcctcaaaaaagaaaaccccaggagcagctcttggagtgtaacaagctgtgtggtaggggccaatccaggcagctttctccagagacctaatggcctcaacaccttctgaacgtggatagtgccagaacacttaggagggtgtctttggaccaatgcatagttgcgactcctgtgctctcttttcagtgtcatggaactggttttgaagagacactctgaaatgataaagacagcctttaatccccctcctccccagaaggaacctcaaaaggtagatgaggtacaaggtcctaagtgatctctttttctgagcaggatatcaggttaaaaaaaaaaagttactggctggtttaatactttctaccttcttcacagagcagcctttgaatagactatgtcctagtgaagacatcaacctccgccttaagctatgtatgtatggaggccagtcgcagctttattatgcagacacacaagtggtctggacatgagggtacagtttctgcctaccaagacactacttgcactggatcttacgcaaaaaagaaccagaacacacagtgtggacaactgcccatatattctatctagattaggagagggtcctggctaggattttagtggtaattcctagttacattcaacaagtataaagattatagagcttattttatgaactataaactataatttaatgcaaaatatccttttatgaatttcatgttaatattgtgaaatattaaaataattccacaatagttgagaaaaatgagcatttttttccatttttaaaaaatgcatagaaaagacaattttaaaatcctgggaccatatttatttagaagtagctgttagtaaaacattagaaaaggagtcaggccattaggttatttatccaaatctctaagcaattaggttgaagttattaagtcaagcctagaaaagctgcctccttgtaaggctttcatgacaatgtatagtaatccacagtgtccaattcttcacactcctcaggaatatcactacctcaggttacggtacacaggctataattgatgatgatgttcagataactgaagacacaataaatgacattcagacatcaggacaattccctcatgttcttttctatgatggccacctgtaccagcaacgtgggtttcacccacacaacgatgaactgttctcttacttctccagttgattttaaagacttgttaagaggtcttactaataaaatttgggtatgatagaaaatccacaatcaaatcttgaaccaaataacatattaaattactaatatttaagtgatggaagacacacaaaaaacttaaaagcacgaacaacctaacttgaaaaagaattttaaaatatgattaacctgaagaaaagagaatcctaagagccaaagctcctttttatttagcttggaattttcctattggttcctaacaaactgtcccaatgtcatataaggaaacatgatctattacattcctttataacaatgtggagagactataaacctatgtaagtagtaaaactatatcagagactcaggagactgactaaaaggcctggatctgcagtgtattatctgtataaaaattggcagggggaagctaaaaggaaaggagattggagatctcaattctatcatggtgtatttcatacgcaaatcagagcatgcattgttttttgtttttggaaagagaagggaagtgtgttctgccccatgtttccttccgtgtttatagttcaaactctatatatacttcaggtattttttgtttagcccttcattataaatgggcaggaaattgtttatcaacctagccagtttattactagtgaccttgacttcagtatcttgagcattcttttatatttttcttttattatcctgagtctgtaactaaacaattttgtcttcaaatttttatccaatatccattgcaccacaccaaatcaagcttcttgattttcaaaaataaaaagggggaaatacttacaacttgtacatatatattcacagtttttatttataaaaaaaatttacagtacttatggagagccagcagaagacatcagagcactcacttcttcccatctttgttaaggttagcgaattacccatggacactgttaggtgaggctcattcggcagccctgaaaacaaacctggtcacactgtctttaccctctcccttcagataaagcacttcgattatctattgatctgcccagttttcaagtcatgcgaatactaaaaaggttacatcatctggatctgtaccttggctatataagcatgttttccccctattctatgtttctttttttggtgaacattgaaaaacaggaggtgacttattactgttaattaaaactaaatgaaaaatgtcaagtctttaaaacagtgagcttgtaactctttcatgtaattttattctctatgaatttggctatcctactgaatcttaaaataaaggaaataaacactttttttttaaaaaaaaggaaaaatacaagtctaaaaatctcaatg

SEQ ID NO: 6192 - DNA, 2555 bp, Homo sapiens
acagagctaccctagtgtccccaggctgaggaggtagtgactggcatacatggctcagtttgtccaggtcctggctgaaataggtgactttggtcgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgagttcaacctggtttgtgatcggaagcacctgaaggacaccacacagtcagtgttcatggctgggctccttgttggcaccctcatgtttgggcccctctgcgaccggattggccgcaaggccacaatcctggcgcagctgctcctcttcaccctcatcggcctggccacagcttttgtgcccagctttgagctctacatggccctgcgctttgctgtggctactgccgtcgctggacttagcttcagcaatgtcaccctactgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctgggctctgccagaatctgcacgttggctcctgacccgtgggaggatggacgaggcgatacaactgatccagaaggcggcctcggtcaataggcggaaactctccccggagctcatgaaccagctggtcccagagaagacaggcccctcagggaatgccctggatctgttcagacacccccagctccggaaggtgaccctgattatcttctgtgtctggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcagatctgcccgtggtggtcaccatgctggctgtggtggggaagatggccacagctgctgcctttaccatctcctatgtgtactctgccgagcttttccccaccatcctccggcagacaggcatggggctggtgggcatcttctcacggatcgggggcatcctcacaccacttgtgatcctgctgggagagtaccacgctgccctccccatgctcatctacggcagcctccccatcgtggccggcctgctgtgcaccctgctgccagagacgcatggccagggcctgaaagacaccctccaggacctggagctggggcctcacccacggtcccccaaatcagtgccctcagagaaggaaacagaggccaagggaagaacttccagcccgggagtggcctttgtgagcagcacatacttctgattgaggtctctaagagctggaccatcagcagcagggagctgcctaaacacctccttggatatggccaggacccacagggacacagggcaagaccagccttgcttatggaggcaggacaccacaatctggcccatggctgtcacctcctgccgagtccaatcccagactgggaaccaccatctgagacaggacctcccggcctccttcacctttctcatctccagagccctgcccccaatactctgtctgggttaggatcttgggtatgtcttggaattaacttgtcctctaacaatcttcatggggtatggctctcttgatctcctcaatctggagtcccctgccctcaaaacacagtgatgttcagaacagaacacaaggtaagccctttccaatttgtgggaacaggaggggagaggaaacaaatgtgaagttgtggactctacccaggcaggtggatgaaaatgctgtggataaaaggaaggttatgattccttctagcggatggaccagattcctctggctaacgtatggccccataggtcactgggtcatacagagagaagattcagttcagcctaaatcaaaacttccaccttgtgttcacttcaaagatggcccaacccccgccctacactcagctcatgcctaacctatgtgtggctcagggaccagcttggggaaggaaaggaggtttgttctgctccccgcctcaccccgcctcctcctgctcatgctcagctgcttctggaccttccagggcccatgcagggtgagggaaagggtagaggtcttttcaccgagctgctgctggttgcagttctttctggtgcacattggctaatgccag

SEQ ID NO: 6193 - DNA, 1079 bp, Homo sapiens
cgcttccagatacagctattgatcctgctgtgtgttctcaacttcctgtctcccttctacttttttgcccatgtcttcatggtcctagatgagccccaccactgtgcagtggcttgggtgaagaaccacactttcaacctgagtgctgctgaacagctggtactgagcgtgcccctggacactgcaggtcacccagagccctgcctcatgttccggccaccccccgccaatgccagcctgcaggacatcctcagccaccgcttcaatgagacgcagccttgtgatatgggctgggaatatcctgagaacaggctcccatccctgaagaatgagttcaacctggtttgtgatcggaagcacctgaaggacaccacacagtcagtgttcatggctgggctccttgttggcaccctcatgtttgggcccctctgcgaccgtgacagaatgggtggggccctcatggaggacgcaggccgtggtcctggcccagtgcaacttctccctcgggcagatggtgcttgcgggactcgcctacggtttccgcaactggaggctccttcagatcaccggcactgcgcctggcttactgctcttcttctacttctgggctctgccagaatctgcacgttggctcctgacccgtgggaggatggacgaggcgatacaactgatccagaaggcggcctcggtcaataggcggaaactctccccggagctcatgaaccagctggtcccagagaagacaggcccctcagggaatgccctggatctgttcagacacccccagctccggaaggtgaccctgattatcttctgtgtctggtttgtggacagtctggggtactacggcctgagcctccaagtgggggacttcggcctggacgtctatctgacgcagctcatctttggagctgttgaggtgcctgcccgctgttccagcatcttcatgatgcagaggtttggccgcaagtggagccagttggggaccttggtcttgggtggcctgatgtgtatcatcatcatcttcatcccagcagatctgcccgtggtggtcaccatgctggctgtggtggggaaga

SEQ ID NO: 6194 - DNA, 2343 bp, Homo sapiens
tgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacaggtttgggagaaggttcgtgctcagatggtgttacctccaggttgccattgttggcacctgtgcagccttggctcccaccttcctcatttactgctcactacgcttcttgtctgggattgctgcaatgagcctcataacaaatactattatgttaatagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagttggctgctagagtctgctcggtggctcattatcaacaataaaccagaggaaggcttaaaggaacttagaaaagctgcacacaggagtggaatgaagaatgccagagacaccctaaccctggagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaagtaattcccaccataatcagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctcaaaaaaaaaaaaaaaaaaaaaagaaagaaggaaagaaagaaagaaaagaaaagaaa

SEQ ID NO: 6195 - DNA, 2151 bp, Homo sapiens
acatttcattgtaaacgactgggagtatctgagcaaattatttcttacgtgactttagagaaaacggctacctatctgaccccaaaacgacttgaggaaactgtttccacggtcctgctgcagaggggaagcacagtcgtcaagaagagagtggggtcaggatcaaaacacatttagtgtgacttagggaaagaaaacattttccctctttgaacctctctggatacagtcattttgcctctacttgaggatcaactgttcaacctcaatggcctttcaggacctcctgggtcacgctggtgacctgtggagattccagatccttcagactgtttttctctcaatctttgctgttgctacataccttcattttatgctggagaacttcactgcattcatacctggccatcgctgctgggtccacatcctggacaatgacactgtctctgacaatgacactggggccctcagccaagatgcactcttgagaatctccatcccactggactcaaacatgaggccagagaagtgtcgtcgctttgttcatcctcagtggcagctccttcacctgaatgggaccttccccaacacaagtgacgcagacatggagccctgtgtggatggctgggtgtatgacagaatctccttctcatccaccatcgtgactgagtgggatctggtatgtgactctcaatcactgacttcagtggctaaatttgtattcatggctggaatgatggtgggaggcatcctaggcggtcatttatcagacagtagccgagtgggcaacacacagattccaggccatgggaattacattgggaatgtgcccttctggtattgcatttatgaccctggcaggcctggcttttgccattcgagactggcatatcctccagctggtggtgtctgtaccatactttgtgatctttctgacctcaagttggctgctagagtctgctcggtggctcattatcaacaataaaccagaggaaggcttaaaggaacttagaaaagctgcacacaggagtggaatgaagaatgccagagacaccctaaccctggagattttgaaatccaccatgaaaaaagaactggaggcagcacaaaaaaaaaaaccttctctgtgtgaaatgctccacatgcccaacatatgtaaaaggatctccctcctgtcctttacgagatttgcaaactttatggcctattttggccttaatctccatgtccagcatctggggaacaatgttttcctgttgcagactctctttggtgcagtcatcctcctggccaactgtgttgcaccttgggcactgaaatacatgaaccgtcgagcaagccagatgcttctcatgttcctactggcaatctgccttctggccatcatatttgtgccacaagaaatgcagacgctgcgtgaggttttggcaacactgggcttaggagcgtctgctcttgccaatacccttgcttttgcccatggaaatgaagtaattcccaccataatcagggcaagagctatggggatcaatgcaacctttgctaatatagcaggagccctggctcccctcatgatgatcctaagtgtgtattctccacccctgccctggatcatctatggagtcttccccttcatctctggctttgctttcctcctccttcctgaaaccaggaacaagcctctgtttgacaccatccaggatgagaaaaatgagagaaaagaccccagagaaccaaagcaagaggatccgagagtggaagtgacgcagttttaaggaattccaggagctgactgccgatcaatgagccagatgaagggaacaatcaggactattcctagacactagcaaaatctagaaaataaataacaaggctgggtgcggtggctcacgcctgtaatcccagcaccttgggaggctgaggcgggcagatcatgaggtcagaagataaagaccaccctggccaacatggtgaaaccctgtctctactaaaacaaatacaaaacttcgctgggcacagtggcacaggcctttaattccagctacttgggaggctgaggcaggagaattacttgaacccaggaggtggaaattgcaatgagccaagattgggccactgcattccagcctggtgacagagcgagactgtctc

SEQ ID NO: 6196 - DNA, 2026 bp, Homo sapiens
caatggcctttgaggagctcttgagtcaagttggaggccttgggagatttcagatgcttcatctggtttttattcttccctctctcatgttattaatccctcatatactgctagagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcaggtactttatggagctgtcgctctcatagttcgatgtcttgctcttttgacactaaatcatatgggccgtcgaataagccagatattgttcatgttcctggtgggcctttccattttggccaacacgtttgtgcccaaagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcaaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatg

SEQ ID NO: 6197 - DNA, 2234 bp, Homo sapiens
tttattgtcaacagctagaagtatctctatgaaataatgatctctatgactacaaaataacatctacctcctgatagcaaaagaactgaggaagctctttccactacggctgtattgcactgagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcaaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaattaaaaaa

SEQ ID NO: 6198 - DNA, 1200 bp, Homo sapiens
gcaacaggttgtctcttcattctgttgatgtgcagaagatttttagcttgaggtagtcgatagagacagctggcaagatggccgaataggaagagctctggtctgcagctcccagcgagagcaatgcggaagccctgtggccatgggagacctggcatccaaggcataccatgagggagcttcacctggatggagactggctcttcccccatcctggcagcctgcctggcagtgcaatggagccaggggtggggctgcagtatgataccagcacttcaggaaccatgggtttcaggagagataccagaagacgtgatgctggtggatggcaatgggcacctcaagtccctcgtcacaatcagtggagacatggttgggcgatgataatggtttcctgccatttcagaagacatacggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgaggtgactggaagcacctgctcaatgtctgctcatcaacaacaaaccagaggagggcttaaaagaactcagaaaagctgcatgctggaatagaatgaagaatgctggagacaccctaaccatggagagaagtaaaaaaagcacctcacctttgagtcgccaaaattatgcttcctggaatgaccgcataccatgtagcaggtttattttagtttgtttacag

SEQ ID NO: 6199 - DNA, 2181 bp, Homo sapiens
gactacaaaataacatctacctcctgatagcaaaagaactgaggaagctctttccactacggctgtattgcactgagaactttgctgcagccattcctggtcatcgttgctgggtccacatgctggacaataatactggatctggtaatgaaactggaatcctcagtgaagatgccctcttgagaatctctatcccactagactcaaatctgaggccagagaagtgtcgtcgctttgtccatccccagtggcagcttcttcacctgaatgggactatccacagcacaagtgaggcagacacagaaccctgtgtggatggctgggtatatgatcaaagctacttcccttcgaccattgtgactaagtgggacctggtatgtgattatcagtcactgaaatcagtggttcaattcctacttctgactggaatgctggtgggaggcatcataggtggccatgtctcagacaggtttgggcgaagatttattctcagatggtgtttgctccagcttgccattactgacacctgcgctgccttcgctcccaccttccctgtttactgtgtactacgcttcttggcaggtttttcttccatgatcattatatcaaataattctttgcccattactgagtggataaggcccaactctaaagccctggtagtaatattgtcatctggtgcccttagtattggacagataatcctgggaggcttggcttatgtcttccgagactggcaaaccctgcacgtggtggcgtctgtacctttctttgtcttctttcttctttcaaggtggctggtggaatctgctcggtggttgataatcaccaataaactagatgagggcttaaaggcacttagaaaagttgcacgcacaaatggaataaagaatgctgaagaaaccctgaacatagaggttgtaagatccaccatgcaggaggagctggatgcagcacagaccaaaactactgtgtgtgacttgttccgcaaccccagtatgcgtaaaaggatctgtatcctggtatttttgagatttgcaaacacaatacctttttatggtaccatggtcaatcttcagcatgtggggagcaacattttcctgttgcagaaatgcagaccctgcgtgtggctttggcatgtctgggaatcggctgttctgctgctactttttccagtgttgctgttcacttcattgaactcatccccactgttctcagggcaagagcttcaggaatagatttaacggctagtaggattggagcagcactggctcccctcttgatgaccttaacggtattttttaccactttgccatggatcatttatggaatcttccccatcattggtggccttattgtcttcctcctaccagaaaccaagaatctgcctttgcctgacaccatcaaggatgtggaaaatcaaaaaaaaaatctcaaggaaaaggcataaaaatgattgctacacaaaagtgaccaaattttaagaagccttcatgagctgattggtggggaaattcagaaaaaaaaatacaggaaaagaacacaccagaagggtttttttccctacaaccagcaagaacatatattagatacatgaatctcaattataattatggcattaatttgcattttatttcaaaattaacttgtggggacatgtaatctcttgagcaatctgatatttttgggaagtcctttaaaaagttacaaatttatcaataaattactagtagataagatgattcagaaacaaaagaaaatcacagaattaggatgtggctggctggtgtatgaagcaccatgtgatgaattcataaagttgcaaaagtcaaaacaatactgtacatgcaaccagaaatcaaaataaatccagaaatagagacctatataaatgcatttaatacatgatacttttgacataataagccattggaaaacggaaagattagatactaaataacattgactatctctttgtaaatacagtcactaaatgatgttagttacttttccatggtggaattttaattactttttctttgtaatttttctctctgtatattttaaacaaatagctggtatagtttacaatattataaagatattgttcaaattgaagggcaaaggccaggttcagcaattttcaaactgtatgtacatttaataaaataactataaatt

SEQ ID NO: 6200 - DNA, 2202 bp, Homo sapiens
ggccagttcctagtcggtggctcccatgctggtctctgatgtttaggaagtggtgtcagcagagactgagctgcaccctttctttggacagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctatcatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttggccactgagtggttagtgggtgagcaccgggcccatgccattatcctgggacactgctttttcgctgttggggccgtgttgctgacagggatcgcctacagtcttccccactggcagctgctgtttctggtgggtgggatacttgtgatccccttcatctcctatatctggattctcccggagtccccgcggtggctgatgatgaaagggaaggtgaaggaggccaagcaggtgctgtgctacgccgcaagtgtgaacaagaagaccattccttcaaatctgctggacgagctgcagctgcccagaaagaaggtgactcgggcctctgtcctggacttctgtaagaataggcagctctgcaaggtgaccttggtgatgagctgtgtgtggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggaataaggtcaaggacatgaagactaaggaaacatcatctgatgatgtctgaggaagcggccaagaatgtcattctcaatgcccagatcctgagattggacccataccctgtctccaaccctgccttgaagcaattcaataaagaggaagcaaacagccaggctccctgagggccaggcccccagaccatcttgggttggaattgagtggccaagtatggggtcatggattccaggccacaaattccaggcctagttcagtctgggggcagggtcagtccttctcccaggccagcccttgacattaaaaaaaatgccccctccttctgcaggagctctgctgtgattcattccaataaaggtacaatgttggtcttga

SEQ ID NO: 6201 - DNA, 1827 bp, Homo sapiens
gttctgcttccaagggtctggctgggcctggattgtggtcagatggcaggagaggagaacttcaaggaagagctcagatcccaggatgcttccaggaacttgaaccagcatgaggtagcaggacatccacattcctggtctctggagatgctgttacgcagattgagggctgtccacaccaagcaggatgacaagtttgccaacctcctggatgcggtgggggagtttggcacattccagcagaggctagtagccctcacctttatccccagcatcatgtcggccttcttcatgtttgctgaccacttcgtgttcacagcccagaagccctattgcaataccagctggatcctggcagtgggcccccacctgtccaaagctgagcagctgaatctgaccataccccaagcacccaatggcagtttcctgacatgcttcatgtaccttcctgtgccttggaatctggattctatcatccagtttggcctcaatgacacagacacatgccaagatgggtggatctatcctgacgctaagaagcgatcgctgatcaatgagtttgacttggtatgtggcatggagacgaagaaggacactgcacagatcatgttcatggcagggctcccgataggctctctcatcttcaggctcataactgacaagatgggccgctaccctgccatcctgctgtcactgctggggctgatcatcttcggctttgggacagccttcatgaacagctttcacctgtatttgttctttcgctttggcatctcgcagtcagtggtgggctacgccatcagcagcatttctttggccactgagtggttagtgggtgagcaccgggcccatgccattatcctgggacactgctttttcgctgttggggccgtgttgctgacagggatcgcctacagtcttccccactggcagctgctgtttctggtgggtgggatacttgtgatccccttcatctcctatatctggattctcccggagtccccgcggtggctgatgatgaaagggaaggtgaaggaggccaagcaggtgctgtgctacgccgcaagtgtgaacaagaagaccattccttcaaatctgctggacgagctgcagctgcccagaaagaaggtgactcgggcctctgtcctggacttctgtaagaataggcagctctgcaaggtgaccttggtgatgagctgtgtgtggtttaccgtcagttacacctattttacgttgagcctgagaatgagagagctgggcgtgagcgtccacttcagacacgtggtccccagcatcatggaggtgcctgcccggctgtgctgcatctttctcctccagcagattgggaggaagtggagcctggctgtgactctcctccaagccatcatctggtgcttgcttctccttttcctccctgaaggggaggatggcctcagactcaagtggccacgttgtccggccacagagctgaaatccatgacgatcttggtgctcatgctcagagagttcagcctggccgccactgtcactgtgttcttcctctacaccgctgagctcctccccactgtgctcagggcgacaggtctggggctggtgtctctggcctcggtggctggagccatcttgtccctgacaatcatcagccagaccccctccctcctgcccatctttctctgctgcgtcttagccatcgtggccttttccctctcctccctgctgccggaaacgcgagatcagcccctctccgagagcctgaaccactcctcacagataaggaataaggtcaaggacatgaagactaaggaaacatcatctgatgatgtctga

SEQ ID NO: 6202 - DNA, 1628 bp, Homo sapiens
ggcgattgcaaagcgcgagggctggaactcagacccagaggggcggtccctgttgcaagtcatctcccgaaagggcggggccggggctcatcccggaaggaccggtgtctaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 6203 - DNA, 1542 bp, Homo sapiens
gacaaaaaaaaaggtctctccgatttcctctgctcaaccagttccctggctacctgaggccctgcttcacctggaggaagacagtggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 6204 - DNA, 1755 bp, Homo sapiens
gcgcagcgtcgcacctctgcccaatgaggtgcccctgacgtgcctgctgcggctgccctgctccccccagcctccctgcatcccgggatgggggagggcgccaggcgcagctcccggaccctcaggggtctccccgccctaccccaccagcctgggttcggtacctcggggctcagatgtgcagtcagctgttaatgtggcaaaatttggggaagtcctctgcagccgcaaaatccagttcccaccagttggaggccgggcggggaagggtggggacagacagcactccgctgtgggaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccagccgcccagatggtcatcacggacctgtcggcacccgaggagcggcccgcggccctgggccggctgggcctctgcttcggcgtcggagtcatcctcggctccctgctgggcgggaccctggtctccgcgtacgggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaactcctactaaatccctccga

SEQ ID NO: 6205 - DNA, 1225 bp, Homo sapiens
tcccggaaggaccggtgtctaggtcaccctggagcgctcaccccaccggcacccgtgcccaagcccgcccctgcaaaggcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggattcagtgcccggccatcctggctgccctggccaccctcctgggagctgtcctcagcttcacctgcatccccgccagcaccaaaggggccaaaactgacgcccaggctccactgccaggcggcccccgggccagtgtgttcgacctgaaggccatcgcctccctgctgcggctgccagacgtcccgaggatcttcctggtgaaggtggcctccaactgccccacagggctcttcatggtcatgttctccatcatctccatggacttcttccagctggaggccgcccaagctggctacctcatgtccttcttcgggctcctccagatggtgacccagggcctggtcatcgggcagctgagcagccacttctcggaggaggtgctgctccgggccagcgtgctggtcttcatcgtggtgggcctggccatggcctggatgtccagcgtcttccacttctgcctcctggtgcccggcctggtgttcagcctctgcaccctcaacgtggtcaccgacagcatgctgatcaaggctgtctccacctcggacacagggaccatgctgggcctctgcgcctctgtacaaccactgctccgaactctgggacccacggtcggcggcctcctgtaccgcagctttggcgtccccgtcttcggccacgtgcaggttgctatcaatacccttgtcctcctggtcctctggaggaaacctatgccccagaggaaggacaaagtccggtgaccgctgcccagacacagactggcaataaac

SEQ ID NO: 6206 - DNA, 635 bp, Homo sapiens
aaaagtggaggagggggaccccctgatgtgtcctctaaggtccaggtagcaggagagctccactggggagggggtcctgcagtgctgtcctctcttgcaggcaaggccaggcgggtgctgcctgggacccagtgactcagcacccctgcccggatcaactggacttttgccccctgctccgccagcctcctgcttggatctctcctgggtctccctgctgcgcctgtccaggatgcagggagctcgggctcccagggaccagggccggtcccccggcaggatgagcgctctaggccggtcctcggtcatcttgcttacctacgtgctggccgccacagaacttacctgcctcttcatgcagttctccatcgtgccatacctgtctcggaaactgggcctggattccattgccttcggctacctgcaaaccaccttcggggtgctgcagctgctgggcgggccggtatttggcaggttcgcagaccagcgcggggcgcgggcggcgctcacgctctccttcctggctgccttggcgctctacctgctcctggcggccgcctccagcccggccctgcccggggtctacctgctcttcgcctcgcgcctgcccggagcgctcatgcacacgctgccag

SEQ ID NO: 6207 - DNA, 1692 bp, Homo sapiens
atggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgagatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgctataggtctgtgctgaggaaagcaaaacaccatttagggctaccatcccccaa

SEQ ID NO: 6208 - DNA, 2327 bp, Homo sapiens
attcatggctggaatgatggtgggaggcaacctatatggccatttgtcagacaggaaaccattatcatcgcccaaccatgtctccactgattgtgacgagggacttgaggtgcccattgccatccaccagcatcacgtcttctggtatctctcctgaaaccctgaatgaaaatggcctccatctgcatccatgttgctgcagaagacatgatttcattcttttttgtggctacatagtattccagtctaccattggtgggcattgaggttattccatgcctttgctactgtgaatagtgcttcaatgaacatgtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctgtatgaagtgtctgttgacccctgctgggaagtgtctcccagtcaggaggcacaggtgttagtgacccacttaaggaggcagtctatcccttagcagagctcaagcactgtgctgagagatccactgctctcttcagagctggcaagcaagaatgtttaagtccactgaagctgcacccacagccaccccttccccaaagtgctctgtcccaggtgatgggagttttatctataagcccttgactggggctgctgcctttctctcagagatgccctgcccagtgaggaggaatctagagaggcagtctggccacagttgctttgcagcactgcagtaagttccacacagtttgaacttcccaatggcttccttaacactgtgaggggaaaactgcctacacaagcctcagtaatggtggacattcctctcccaccaaggttgatcatcccagttcgacctcagactgatgtgctggcagtgagaatttcaagccagtggttcttagcttgctgggctccatgggagtgggacctgctgagcgagaccacttggctttctggcatcagccccttctccaggagagtgaatggttctgtctcactgaggttccagcattggcacacaagggaatctcctggtctgcgtgttgcaaaaactatgggaaaagcataatttctgggctggatagcacagtccctatggcttccttgggtaggtgaggaagttccctggccctttggacttcctgggtgaggtgatgccccaccctgcttcagcttaccctccgtgggctgcacccacccgctgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgctttt

SEQ ID NO: 6209 - DNA, 3701 bp, Homo sapiens
atggcctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggaaaccattatcatcgcccaaccatgtctccactgattgtgacgagggacttgaggtgcccattgccatccaccagcatcacgtcttctggtatctctcctgaaaccctgaatgaaaatggcctccatctgcatccatgttgctgcagaagacatgatttcattcttttttgtggctacatagtattccagtctaccattggtgggcattgaggttattccatgcctttgctactgtgaatagtgcttcaatgaacatgtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctgtatgaagtgtctgttgacccctgctgggaagtgtctcccagtcaggaggcacaggtgttagtgacccacttaaggaggcagtctatcccttagcagagctcaagcactgtgctgagagatccactgctctcttcagagctggcaagcaagaatgtttaagtccactgaagctgcacccacagccaccccttccccaaagtgctctgtcccaggtgatgggagttttatctataagcccttgactggggctgctgcctttctctcagagatgccctgcccagtgaggaggaatctagagaggcagtctggccacagttgctttgcagcactgcagtaagttccacacagtttgaacttcccaatggcttccttaacactgtgaggggaaaactgcctacacaagcctcagtaatggtggacattcctctcccaccaaggttgatcatcccagttcgacctcagactgatgtgctggcagtgagaatttcaagccagtggttcttagcttgctgggctccatgggagtgggacctgctgagcgagaccacttggctttctggcatcagccccttctccaggagagtgaatggttctgtctcactgaggttccaggtcccactgggggaaaaaaaaaaaactcctgcagctagctcagtgtctccccaaacagccacctagttttgcacttgaaacccagggccctggtagcattggcacacaagggaatctcctggtctgcgtgttgcaaaaactatgggaaaagcataatttctgggctggatagcacagtccctatggcttccttgggtaggtgaggaagttccctggccctttggacttcctgggtgaggtgatgccccaccctgcttcagcttaccctccgtgggctgcacccacccgctgtctaaccagtcccagtgagatgaaccgggtacctcagttggaaatgcagaaatcactcaccttccgcattgctctcgctgggagctgcagaccagagctcttcctattcggccatcttgccagctgtctctatcgactacctcttattccaaaaaataaaaccataatgaagttagacaccattaaatatacataatataaaaataggttttcttattctaatctagatttgctacacaagaccatctacagaatgaatgccatgaatatacaatctgtacccaataagttgtacattttagtaaacattcctgattgtaagggtggcaaatggaaattttggcttcttagatctttactgtgagtttgactgacatcagtacatttttatttttaattgtatattttcattactgtgaatttttttgcagtgatttttgatgccatgtggctacattggttttagaatactaataaaatccattgcttttaaaataaataaataaaccccatagcacatcctccatacaacatctgttgtccctcaagatacaattgttaccactatcatctaaccattattttatgataactttaaaatatcaacttgcaagaaaatattccacaaaacacactctgcctttttactttaaagagtccttggctacctgggccaatattattctcatttgtaggatttaggttccacagattataatatgtgcctttttctgtgttccctgcagatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgcta

SEQ ID NO: 6210 - DNA, 1788 bp, Homo sapiens
ctttcaggacctcctagatcaagttggaggcctggggagattccagatccttcagatggttttccttataatgttcaacgtcatagtataccatcaaactcagctggagaacttcgcagcattcatacttgatcatcgctgctgggttcatatactggacaatgacactatccctgacaatgaccctgggaccctcagccaggatgccctcctgagaatctccatcccattcgactcaaatctgaggccagagaagtgtcgtcgctttgtccatccccagtggaagctcattcatctgaatgggaccttccccaacacgagtgagccagatacagagccctgtgtggatggctgggtatatgaccaaagctccttcccttccaccattgtgactaagtgggatctggtatgcgaatctcaaccactgaattcagtagctaaatttctattcatggctggaatgatggtgggaggcaacctatatggccatttgtcagacaggtttgggagaaagttcgtgctcagatggtcttacctccagctcgccattgtaggcacctgtgcggcctttgctcccaccatcctcgtatactgctccctgcgcttcttggctggggctgctacatttagcatcattgtaaatactgttttgttaattgtagagtggataactcaccaattctgtgccatggcattgacattgacactttgtgctgctagtattggacatataaccctgggaagcctggcttttgtcattcgagaccagtgcatcctccagttggtgatgtctgcaccatgctttgtcttctttctgttctcaaggtggctggcagagtctgctcggtggctcattatcaacaacaaaccagaagagggcttaaaggaacttagaaaagctgcacacaggaatggaatgaagaatgctgaagacatcctaaccatggaggttttgaaatccaccatgaagcaagaactggaggcagcacagaaaaagcattctctttgtgaattgctccgcatacccaacatatgtaaaagaatctgtttcctgtcctttgtgaggtctgctggagtttgctggaggtccactccagatcctgtttgcttgggtatcaccagcggaggttgcagaacagcaaagattcctgcctgctccttcctctggaagcttcattttagaggagcacctgcctgatgccagccagagctctcctatttgcaagtaccatccctttttggggccttactttgcacctccagcatctgggaaacaatgttttcctgttgcagactctctttggtgcagtcaccctcctggccaattgtgttgcaccttgggcactgaatcacatgagccgtcgactaagccagatgcttctcatgttcctactggcaacctgccttctggccatcatatttgtgcctcaagaaatgcagaccctgcgtgtggttttggcaaccctgggtgtgggagctgcttctcttggcattacctgttctactgcccaagaaaatgaactaattccttccataatcaggggaagagctactggaatcactggaaactttgctaatattgggggagccctggcttccctcatgatgatcctaagcatatattctcgacccctgccctggatcatctatggagtctttgccatcctctctggccttgttgtcctcctccttcctgaaaccaggaaccagcctcttcttgacagcatccaggatgtggaaaatgagggagtaaatagcctagctgcccctcagaggagctctgtgcta

SEQ ID NO: 6211 - DNA, 2037 bp, Homo sapiens
accctctccccaccttctccccaccccaggcttcacccaaactctgacctcttactctctctacttaactctggtcccgggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctcacctgggctcctgccagtttcatgtgtgcccctggaggcgagcttcaacgtcatcaactcacactcctctccctgtcttccggctcctttcggaactgtctgcccccaccaaggcaccatggatttggctgcctcacccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatagggtgggttgcctttccttgtcttaattaggcctaactgttccagagcagaggccatgatttagtggaccatgaatgattgagattttgcctgtgtactatcaatgccacttgaaccccagcattcactttaatacttactgagcatctcccatgtgcaaggtcctggaactacagggataagacagggtccatgccgtctcaaggcatttacggtttaaaaagacctttgtaattactaacgaaaatgcaaagcagaaagcagtctgtaataaagattaaaataatgccgtgggagcaaa

SEQ ID NO: 6212 - DNA, 1958 bp, Homo sapiens
accctctccccaccttctccccaccccaggcttcacccaaactctgacctcttactctctctacttaactctggtcccgggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggagggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatagggtgggttgcctttccttgtcttaattaggcctaactgttccagagcagaggccatgatttagtggaccatgaatgattgagattttgcctgtgtactatcaatgccacttgaaccccagcattcactttaatacttactgagcatctcccatgtgcaaggtcctggaactacagggataagacagggtccatgccgtctcaaggcatttacggtttaaaaagacctttgtaattactaacgaaaatgcaaagcagaaagcagtctgtaataaagattaaaataatgccgtgggagcaaagaggaa

SEQ ID NO: 6213 - DNA, 2010 bp, Homo sapiens
gggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccaggtgagtggaattggcctttgctgacgcccagagctctggctgcaggcatctccatggccttggcagcctccaccagttccctgggctgctatgccctgtgtggccggctgctgcatttgcctcccccacctccacatgcctgcagtcgagggctgagcctggaggggctgggcagtgtgctggccgggctgctgggaagccccatgggcactgcatccagcttccccaacgtgggcaaagtgggtcttatccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaatag

SEQ ID NO: 6214 - DNA, 2048 bp, Homo sapiens
cttaactctggtcccgggcagccaagacaaagcgaaaggcaaggcagcatgagccgatcacccctcaatcccagccaactccgatcagtgggctcccaggatgccctggcccccttgcctccacctgctccccagaatccctccacccactcttgggaccctttgtgtggatctctgccttggggcctcagctgtcttctggctctgcagcatgtcttggtcatggcttctctgctctgtgtctcccacctgctcctgctttgcagtctctccccaggaggactctcttactccccttctcagctcctggcctccagcttcttttcatgtggtatgtctaccatcctgcaaacttggatgggcagcaggctgcctcttgtccaggctccatccttagagttccttatccctgctctggtgctgaccagccagaagctaccccgggccatccagacacctggaaactgtgagcacagagcaagggcaagggcctccctcatgctgcacctttgtaggggacctagctgccatggcctggggcactggaacacttctctccaggaggtgtccggggcagtggtagtatctgggctgctgcagggcatgatggggctgctggggagtcccggccacgtgttcccccactgtgggcccctggtgctggctcccagcctggttgtggcagggctctctgcccacagggaggtagcccagttctgcttcacacactgggggttggccttgctggttatcctgctcatggtggtctgttctcagcacctgggctcctgccagtttcatgtgtgcccctggaggcgagcttcaacgtcatcaactcacactcctctccctgtcttccggctcctttcggtgctgatcccagtggcctgtgtgtggattgtttctgcctttgtgggattcagtgttatcccccaggaactgtctgcccccaccaaggcaccatggatttggctgcctcacccaggtgagtggaattggcctttgctgacgcccagagctctggctgcaggcatctccatggccttggcagcctccaccagttccctgggctgctatgccctgtgtggccggctgctgcatttgcctcccccacctccacatgcctgcagtcgagggctgagcctggaggggctgggcagtgtgctggccgggctgctgggaagccccatgggcactgcatccagcttccccaacgtgggcaaagtgggtcttatccaggctggatctcagcaagtggctcacttagtggggctactctgcgtggggcttggactctcccccaggttggctcagctcctcaccaccatcccactgcctgttgttggtggggtgctgggggtgacccaggctgtggttttgtctgctggattctccagcttctacctggctgacatagactctgggcgaaatatcttcattgtgggcttctccatcttcatggccttgctgctgccaagatggtttcgggaagccccagtcctgttcagcacaggctggagccccttggatgtattactgcactcactgctgacacagcccatcttcctggctggactctcaggcttcctactagagaacacgattcctggcacacagcttgagcgaggcctaggtcaagggctaccatctcctttcactgcccaagaggctcgaatgcctcagaagcccagggagaaggctgctcaagtgtacagacttcctttccccatccaaaacctctgtccctgcatcccccagcctctccactgcctctgcccactgcctgaagaccctggggatgaggaaggaggctcctctgagccagaagagatggcagacttgctgcctggctcaggggagccatgccctgaatctagcagagaagggtttaggtcccagaaatgaccagaacgcctacttctgccctggttaatttagccctaactctcatctgctggagagtcagctcccaaactgttctttcttgtaggcagaggatatgtgtgtgtgtattacatgggactgtctagaggttccatttcccaata

SEQ ID NO: 6215 - DNA, 4271 bp, Homo sapiens
agcggcgggacggccacaccctgcgctccgcgcgggctcgggtggggtctccgctcctgcgccctgcgccctgcgcgccgcagccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaattacttgttttccagtttttattttttttagagaaaattcttaagtctcagtttcctaattgaaaaaaaaaaattataaataaagcaaaaattgtatcctacagcttagctagcttagatgtttggcaccagtttgaatcatgctttttacagctggctccatgtagtctttccaaacattttggcctttcctgagcagcccttgtagatattgtctgtatgatgcattttgacacaaggtgatattttttgtgatatcaaaattccacatttacccattagagttacagccctggggttcacagtaccaagggggacccagagcctcaggattggccaggctcattttgccgtggagtatcagtttgtcttgaaattgtgggaaaaaattctaagttgaattcactggtaagtaattttttaaaatttcataatgcagattacatccaaaatttgatttaaaaattaaaacataagactgcagagaaattctgcatttcaactccaatactatccagacttcagaaataacttatcagttatttctgtaagcttcttgcttacctggatacctgacaggtgagatggctgtagcagacactggcagttccctgcccacacacctgtccctgtccacagctgcacaaggcagctctgtgtgcaattgccagcatctgctcctctgttctcagggaatctttgttagaaaaatgctgccatatttgtttctcacctattagtcttgtctcccagtcaagagaataaatttatgcaagcagagattgta

SEQ ID NO: 6216 - DNA, 2055 bp, Homo sapiens
ggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacgctctcttctgctgggttctctgcctggataaaagattctacggctgaacagaatcgttcaaaaaccacggtcttggccaggcgcagtggctcacacctaaaatcccagcactttgggaggccgaagtgggcggatcacgaggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaaggctggagtacagtggctcgatttcagatcactgcaacctctgccttccaggttcaagcgattctcctgcctcagcctccagagtagctggtattacaggatttcatcatgttgcccaggctcatctcgaactcgtggggtcaaggaattcgccagccttcagcctcccaacgtgctgggattacagccggtggtcatgccatgagcagccttatggagaggaccatgtggtaaggaactcagccaatagccatgtaactgagcttggaagaggatcttgctgtcctggccaacatctcactgcaattctatcagttgaattccctggatagtccaagctttgtggatccctccaccgaaacaactggatcccagtacctgaatcctgaatcttagactcttatacttcaaacactgatcacgggaacagccggctcagcggctcctgagttcctaatgctcagaatatgggtgagatgataaatgtttgttgtgttaagctgccaacctttggcgggggggtaattcgtcacatggcaacagctggctaatacatatatacctacatgt

SEQ ID NO: 6217 - DNA, 3460 bp, Homo sapiens
agagccgagcggactgcgcggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggattccctgtacctcaacacccagaccctgcctccctcaggcaccagatccagtgtcctagtgaaacgctggatcctagatccccaaccccagatccccatgcctcgagccctggatctccaagctcagctgctggattctggatgtcaacaaacctcaccactggatcctgacaaccacaatgcctggatcctggggcccccatcactggatcccagatcccctcactccacccactggattcctgcattggtttttggttttttgtttttttttaacctcgacactgggtctcagatccttctgctgactgccagatccctgcatttcaagcactacgccttccacccccaggcactggatcccagattcccaagccttcacccaccagattctggctcctaaaacaagtgcgggggccccagtggcacagcaagtggatcctggcaactgcagctgctggattccagattctgggtccccaatccctctgcccagtccctcaatgttgaaacctcatctcttgaaggcagatcctgatattccaaggcactgaatcccaagccctgaatccccggtttctgatctgaatcttccaggcgccgggtcccaaatgttcaggccccaagtctagatcctggcagcccagtcacagagtatcccacacacactggtgcccagagccggcttctcatgacatgaaattgcatggtcgagggagtctgtggggaaggaagcccaggtcctggctgcaacctgcacggatgctggattccccctcaccccacctctgcatggccaccccctcccagccctgtggggaaactgttccctggaaccactccactccctgcatccccacacttcacagcatcttccatccccctcccaccttctaggcgaatagtccccagagctgtgttcctccaaggggtccgaggaatcactcactcctggaggctggcaaggagacagtctgaggccagggacacatgaagggatgtccccaccccagcactatcagggcctccccaggcttccagagttgaaagccaggagaaaatcggcaaagaccacccttccctaaacccaagcacccaatgatgcaaaaaacaaaaacaaaaaaaaaccaccaaatccccaaattcattccagatctatttttctaccagagagaggagcaaagtcctcctcccctgcgcccttacattctgcacttcatagttggattctgagcttaggatcatctggagaccccatggagggacttggaaaggggaactgggatttggggaggggctggaggacttccgcacgcttccacctccttcgacctccactgcgccccacctccctgcctgtgtgtgttatttcaaaggaaaagaacaaaaggaataaattttctaagctcttt

SEQ ID NO: 6218 - DNA, 1440 bp, Homo sapiens
ggaggctgcggagccggcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagatgtgtcagtgtacaagacggacacggtccccaccctcatagagctcacaggccggagaggaaggaagatgctaaataaatcattctggaattaa

SEQ ID NO: 6219 - DNA, 1210 bp, Homo sapiens
gcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagcctccatcgagggtggcccccagctgtccatgctgggtctgctacgtcacatcctgtcccaggagggcatgcggggcctctaccgggggatcgcccccaacttcatgaaggttattccagctgtgagcatctcctatgtggtctacgagaacatgaagcaggccttgggggtcacgtccaggtgagggacccggagcccgtccccccaatccctcaccccccacacctcagccactggagactgatgatccaaccacaggatccctactctttggccacgagatcccagtacccagatcctggatcctagactcctatgccccaaccattgggtcatgggatcccagcatccagatcctggatcctagactcctatgccccaaccactgggtcatgcgatccccacccttcagccactagatcccagatccccctgtaaccataactgtggatcccttacttcagcaactcaagtctgctaccctaaccacaagattcaagattatccacaccccagcccttaatccccatcccccaaatcactggatcctgcagccccacatcctaaggtggatcccacgcttccctgtgccccctactggatcctggacctctacgtcttaaccactggatcccacacaaatcagtgaatggatcccaacaccccaaccacaggagcacggatt

SEQ ID NO: 6220 - DNA, 1376 bp, Homo sapiens
gcggccgcgggagctgaccctgcggggtcccggggggggagggggagccgcgaagcccccactgaggccgccgctgccgggcctcccctcccccccgggcgggcgccatgcgggggagcccgggcgacgcggagcggcggcagcgctggggtcgcctgttcgaggagctggacagtaacaaggatggccgcgtggacgtgcacgagttgcgccaggggctggccaggctgggcgggggcaacccagaccccggcgcccaacagggtatctcctctgagggtgatgctgacccagatggcgggctcgacctggaggaattttcccgctatctgcaggagcgggaacagcgtctgctgctcatgtttcacagtcttgaccggaaccaggatggtcacattgatgtctctgagatccaacagagtttccgagctctgggcatttccatctcgctggagcaggctgagaaaattttgcacagcatggaccgagacggcacaatgaccattgactggcaagaatggcgcgaccacttcctgttgcattcgctggaaaatgtggaggacgtgctgtatttctggaagcattccacggtcctggacattggcgagtgcctgacagtgccggacgagttctcaaagcaagagaagctgacgggcatgtggtggaaacagctggtggccggcgcagtggcaggtgccgtgtcacggacaggcacggcccctctggaccgcctcaaggtcttcatgcaggtccatgcctcaaagaccaaccggctgaacatccttggggggcttcgaagcatggtccttgagggaggcatccgctccctgtggcgcggcaatggtattaatgtactcaagattgcccccgagtcagctatcaagttcatggcctatgaacagatcaagagggccatcctggggcagcaggagacactgcatgtgcaggagcgcttcgtggctggctccctggctggtgccacagcccaaaccatcatttaccctatggaggtgctgaagacgcggctgaccttgcgccggacgggccagtataaggggctgctggactgcgccaggcgtatcctggagagggaggggccccgtgccttctaccgcggctacctccccaacgtgctgggcatcatcccctatgcgggcatcgacctggccgtctacgagactctgaagaactggtggcttcagcagtacagccacgactcggcagacccaggcatcctcgtgctcctggcctgcggtaccatatccagcacctgcggccagatagccagttacccgctggccctggtccggacccgcatgcaggcacaagccggtggtcatgccatgagcagccttatggagaggaccatgtggtaa

SEQ ID NO: 6221 - DNA, 3405 bp, Homo sapiens
gccgcaaccccgacggcgccccaaacgctgttgcgccgcgcgccccgcccagcccggcctcgcgctggtcccggtctcgccccgcagccctcgatctcccgtgacttcctcggccaggccgcctgcgcctctgggaccatgttgcgctggctgcgggacttcgtgctgcccaccgcggcctgccaggacgcggagcagccgacgcgctacgagaccctcttccaggcactggaccgcaatggggacggagtggtggacatcggcgagctgcaggaggggctcaggaacctgggcatccctctgggccaggacgccgaggagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaatta

SEQ ID NO: 6222 - DNA, 3395 bp, Homo sapiens
aggatgagccctctccttccagagctttaaccgatgaaggtgcattgtgtttggcgcccctgaggaggatgctgtcttaggcctcttcccactggacgtgtgtggtgggcagagatcccgttcgtcggtcgcacttccaccccgctggggctcactcaggccgcggagctgcgagggagacatcctcgatggactccctctacggagatctcttttggtacctggactataacaaggatgggaccttggacatttttgagcttcaggaaggcctggaggatgtaggggccattcaatctctagaggaagcgaagaaaatttttactactggagatgtcaacaaagatgggaagctggattttgaagaatttatgaagtaccttaaagaccatgagaagaaaatgaaattggcatttaagagtttagacaaaaataatgatggaaaaattgaggcttcagaaattgtccagtctctccagacactgggtctgactatttctgaacaacaagcagagttgattcttcaaagcattgatgttgatgggacaatgacagtggactggaatgaatggagagactacttcttatttaatcctgttacagacattgaggaaattatccgtttctggaaacattctacaggaattgacataggggatagcttaactattccagatgaattcacggaagacgaaaaaaaatccggacaatggtggaggcagcttttggcaggaggcattgctggtgctgtctctcgaacaagcactgcccctttggaccgtctgaaaatcatgatgcaggttcacggttcaaaatcagacaaaatgaacatatttggtggctttcgacagatggtaaaagaaggaggtatccgctcgctttggaggggaaatggtacaaacgtcatcaaaattgctcctgagacagctgttaaattctgggcatatgaacagtacaagaagttacttactgaagaaggacaaaaaataggaacatttgagagatttatttctggttccatggctggagcaactgcacagacttttatatatccaatggaggttatgaaaaccaggctggctgtaggcaaaactgggcagtactctggaatatatgattgtgccaagaagattttgaaacatgaaggcttgggagctttttacaaaggctatgttcccaatttattaggtatcataccttatgcaggcatagatcttgctgtgtatgagctcttgaagtcctattggctggataattttgcaaaagattctgtaaaccctggagtcatggtgttgctgggatgcggtgccttatccagcacctgtggtcagctggccagctacccattggctttggtgagaactcgcatgcaggctcaagccatgttagaaggttccccacagctgaatatggttggcctctttcgacgaattatttccaaagaaggaataccaggactttacagaggcatcaccccaaacttcatgaaggtgctccctgctgtaggcatcagttatgtggtttatgaaaatatgaagcaaactttaggagtaacccagaaatgatgttgcattttttgctttagcctgataattgaaactttcaacaatctctggagtgactttttctcctcgaattgaaacaagtctatggcaaaagaagctgcatttttttcacaaaagggaagatggtaacaatggtcacttcaaacttttgggctaaattatatgtacacagaaatgttcaaaatcatagttttaatgtgttttgaaaaggccacacaattatactttatcttttcttaataatcctgcaaatctctgccctgaatccgaaatctgaaaatgtactggcttgaacaaaatttgttttgtgtgttagagttataaatcattaatctttatttcgggtggtttacgtttatgccagttcctttatatttaaatttcttgttttatatattttgaatgtctttatagatttctttaaatttccttatagaaccattaatagaaaatcattacatttaaaatataccttacagcaaaagcatccaaataagtatagggtttatgtccttatttttctttcagctgaatacgaatgaacacagtggtggaatttctgaagggaagtgatgaaattatatttatttcagtgggcacttttccattttaccactgtaccattatttggttcctggagttatacactaattttcagtatattactgttaaattaccaacacaaggcaatttatttgaaagattccgtttatcctgccattgctttgaaaagcagcaggaaacgaaatcctttgacttgtatcagcttctgcagagcatctttgttttcctttgtcctttgtttcctaccttttgaatcagattccgttttagtcaggaagacttcttgggaccattcttagtaacctgaaatttcttttttaattgcatgaagtggattgatcatgagcaaatgatgtgcttatttctccctcactgttgaatatctttgaacttgctgttttcaatatgggcagcacaaaggtgagagatacatattaatagtagtatgtattactcttatacattagatacctatatttaaatgaaaggcccaatttgtaaacatatacattcatattctctcttgccccaagttttaggaacatgttaggatataggagacttaatttataataatgagagcatttttttattttactaaagccatttttatagtcaactatcttttcttatttgtgtgattagaacttagaaaaatatttactagttgaagttattatcagtttttaatttagttcttaaactcatttcacttctaataatttctgttataaatttccagcattttaatgaaaatctaatgatgtaataggcattttctttatttgaacctacctcttttattttctgaaccaaagagaaagatggactggtgtttgtgaaacatttttaaaaatgtagtttcatttatattagttatgtttgataaatgtctcagtatttttataatatgataagcctgggattctacttttagggttatttgtacttttgagtaatatataaagtgacaatattaaggtacatgatcagctctttctatttttactcgtaaaaattatggaaatgaataattttgctaacaactttgaaatttcaaacttctggaaaatatgaaaatattcattgttcattatgaatttaaattgtaaggtatgaatgtgatttgtctgtacatcttgtatcttttccaaaaaatgattctgtatcttttggaaaaaagccgagagttgaagatagtatatttctggtagtactgaatatttacttacagtttctatcaaaaatatatatttgtttctaaaa

SEQ ID NO: 6223 - DNA, 3474 bp, Homo sapiens
cggtgacgtcagccctgatctttgtgcctctcacttgagcaacctgatgccaccttctcccccgggctctgtgttcattggctgttggcaggacttgccgtgggagggcttttttcttttttcaattaagtaaaagggcagggcttaagcagccaatgacagctgaggccaggcttgtcttatgcaagtttcccgggaccggcagcatttagggaacttgctcccggtggtgagggcagtggagcacccagcaggccgccaacatgctctgtctgtgcctgtatgtgccggtcatcggggaagcccagaccgagttccagtactttgagtcgaaggggctccctgccgagctgaagtccattttcaagctcagtgtcttcatcccctcccaggaattctccacctaccgccagtggaagcagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 6224 - DNA, 3714 bp, Homo sapiens
gcgaggacagctgaataactgggagctcgaagttgcttgctgcctccgggagtggtctgcttggctgtcgcgttttccttttctttttttttttttttaaaaaaaagccaaacgtttgctcaccatcacctgcagaagtgagtttttattgaagaagctccagctgctttctccttattgccggcagcctggcaagcctcccttagagtgagctacttctcaggccgggcacgacagcagtgctagcacatttgaaaaagcaggaaaccgcccctgcatgcagagcttccagcctgagaaccccaggcccgtcctcccagcagctgtgtagccagagagcgttggtactgtggtcacatccctcaaaagtgaacagtcgccatcagaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagaatacgaacgggccatttctggggccctgtcacctacatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 6225 - DNA, 3431 bp, Homo sapiens
tgccggcgtctccgagcccgcgctcccagctgcagagcgcctggcttgcctcccgcgcggtcaccgccggcccgccgcccccgctcccgcccgcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctg

SEQ ID NO: 6226 - DNA, 3376 bp, Homo sapiens
gcgcccggagcccctgcctcgcgcccgatggtgagcagtgtgttgtgccgctgtgtggcctccccgccgccggacgccgccgccaccgccgcctcttcgtctgcctcatcgccggcgtccgtgggggacccctgcggcggcgctatctgcgggggcccggaccaccggctgcgcctgtggagactctttcagacgctcgacgtcaaccgggacggcggcctgtgtgtcaacgacctggcggtggggctgcggcgcctgggactgcaccgcaccgagggcgagctccagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagaatacgaacgggccatttctggggccctgtcacctacatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 6227 - DNA, 3678 bp, Homo sapiens
gcgaggacagctgaataactgggagctcgaagttgcttgctgcctccgggagtggtctgcttggctgtcgcgttttccttttctttttttttttttttaaaaaaaagccaaacgtttgctcaccatcacctgcagaagtgagtttttattgaagaagctccagctgctttctccttattgccggcagcctggcaagcctcccttagagtgagctacttctcaggccgggcacgacagcagtgctagcacatttgaaaaagcaggaaaccgcccctgcatgcagagcttccagcctgagaaccccaggcccgtcctcccagcagctgtgtagccagagagcgttggtactgtggtcacatccctcaaaagtgaacagtcgccatcagaggcgtttggaggagaccgtgatgttgcagatgctgtggcatttcctagctagctttttccccagggctgggtgccacggctccagagagggggacgatcgtgaagtcagaggcaccccagcccctgcctggagagaccagatggcaagctttttggggaaacaggacggaagggctgaggccacggaaaaaagacccaccattttgctggtggttggacctgcagagcagtttcctaagaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 6228 - DNA, 3264 bp, Homo sapiens
ggccgccaacatgctctgtctgtgcctgtatgtgccggtcatcggggaagcccagaccgagttccagtactttgagtcgaaggggctccctgccgagctgaagtccattttcaagctcagtgtcttcatcccctcccaggaattctccacctaccgccagtggaagcaggtctgtggggtgaccgcgcggaagggagaggcgcattcaaccgaaaattgtacaagctggagataaggaccttgatgggcagctagactttgaagaatttgtccattatctccaagatcatgagaagaagctgaggctggtgtttaagagtttggacaaaaagaatgatggacgcattgacgcgcaggagatcatgcagtccctgcgggacttgggagtcaagatatctgaacagcaggcagaaaaaattctcaagagcatggataaaaacggcacgatgaccattgactggaacgagtggagagactaccacctcctccaccccgtggaaaacatccccgagatcatcctctactggaagcattccacgatctttgatgtgggtgagaatctaacggtcccggatgagttcacagtggaggagaggcagacggggatgtggtggagacacctggtggcaggaggtggggcaggggccgtatccagaacctgcacggcccccctggacaggctcaaggtgctcatgcaggtccatgcctcccgcagcaacaacatgggcatcgttggtggcttcactcagatgattcgagaaggaggggccaggtcactctggcggggcaatggcatcaacgtcctcaaaattgcccccgaatcagccatcaaattcatggcctatgagcagatcaagcgccttgttggtagtgaccaggagactctgaggattcacgagaggcttgtggcagggtccttggcaggggccatcgcccagagcagcatctacccaatggaggtcctgaagacccggatggcgctgcggaagacaggccagtactcaggaatgctggactgcgccaggaggatcctggccagagagggggtggccgccttctacaaaggctatgtccccaacatgctgggcatcatcccctatgccggcatcgaccttgcagtctacgagacgctcaagaatgcctggctgcagcactatgcagtgaacagcgcggaccccggcgtgtttgtgctcctggcctgtggcaccatgtccagtacctgtggccagctggccagctaccccctggccctagtcaggacccggatgcaggcgcaagcctctattgagggcgctccggaggtgaccatgagcagcctcttcaaacatatcctgcggaccgagggggccttcgggctgtacagggggctggcccccaacttcatgaaggtcatcccagctgtgagcatcagctacgtggtctacgagaacctgaagatcaccctgggcgtgcagtcgcggtgacggggggagggccgcccggcagtggactcgctgatcctgggccgcagcctggggtgtgcagccatctcattctgtgaatgtgccaacactaagctgtctcgagccaagctgtgaaaaccctagacgcacccgcagggagggtggggagagctggcaggcccagggcttgtcctgctgaccccagcagaccctcctgttggttccagcgaagaccacaggcattccttagggtccagggtcagcaggctccgggctcacatgtgtaaggacaggacattttctgcagtgcctgccaatagcgagcttggagcctggaggccggcttagttcttccatttcacccttgcagccagctgttggccacggcccctgccctctggtctgccgtgcatctccctgtgccctcttgctgcctgcctgtctgctgaggtaaggtgggaggagggctacagcccacatcccaccccctcgtccaatcccataatccatgatgaaaggtgaggtcacgtggcctcccaggcctgacttcccaacctacagcattgacgccaacttggctgtgaaggaagaggaaaggatctggccttgtggtcactggcatctgagccctgctgatggctggggctctcgggcatgcttgggagtgcagggggctcgggctgcctggcctggctgcacagaaggcaagtgctggggctcatggtgctctgagctggcctggaccctgtcaggatgggccccacctcagaaccaaactcactgtccccactgtggcatgagggcagtggagcaccatgtttgagggcgaagggcagagcgtttgtgtgttctggggagggaaggaaaaggtgttggaggccttaattatggactgttgggaaaagggttttgtccagaaggacaagccggacaaatgagcgacttctgtgcttccagaggaagacgagggagcaggagcttggctgactgctcagagtctgttctgacgccctgggggttcctgtccaaccccagcaggggcgcagcgggaccagccccacattccacttgtgtcactgcttggaacctatttattttgtatttatttgaacagagttatgtcctaactatttttatagatttgtttaattaatagcttgtcattttcaagttcattttttattcatatttatgttcatggttgattgtaccttcccaagcccgcccagtgggatgggaggaggaggagaaggggggccttgggccgctgcagtcacatctgtccagagaaattccttttgggactggaggcagaaaagcggccagaaggcagcagccctggctcctttcctttggcaggttggggaagggcttgcccccagccttaggatttcagggtttgactgggggcgtggagagagagggaggaacctcaataaccttgaaggtggaatccagttatttcctgcgctgcgagggtttctttatttcactcttttctgaatgtcaaggcagtgaggtgcctctcactgtgaatttgtggtgggcgggggctggaggagagggtgggggactggctccgtccctcccagccttctgctgcccttgcttaacaatgccggccaactggcgacctcacggttgcacttccattccaccagaatgacctgatgaggaaatcttcaataggatgcaaagatcaatgcaaaaattgttatatatgaacatataactggagtcgtcaaaaagcaaattaagaaagaattggacgttagaagttgtcatttaaagcagccttctaataaagttgtttcaaagctga

SEQ ID NO: 6229 - DNA, 894 bp, Homo sapiens; identical to SEQ ID NO: 3834

SEQ ID NO: 6230 - DNA, 2385 bp, Homo sapiens
cactcggcgcccccacccgggccctgccggcaggcacgaggggcggggcgcgcggcccgaggtgagggaccgcgggccggaggggatccagcgagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtgtggcaggcgtgcttgtgggacacccgtttgacacggtcaaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaagtggc

SEQ ID NO: 6231 - DNA, 2242 bp, Homo sapiens
gagtcagctgccgccgagggaccagcgcgggtctagctgctgccgccatccccaccatccctgaccgcgcctgcccgggctccgcgccaggaggagcggccaggcccagccccggcaccgcgcgctcggggaccccgacggcgcccagcccggcgaggggcctcagggggaggacgaggaggaaaggcggcctcgccggggacccggccatggcgctggacttcttggctggatgcgcggggggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgtttttt

SEQ ID NO: 6232 - DNA, 5169 bp, Homo sapiens
ctgccacccaggagaaacagaacatggccagccctctggaagtcttccctcctgctcctatcaactcctccctccccttctgaggcttccactggcctaacttcctcctttttttttgagacacggtcttgctctgtcaccctaggtggagtgcagtggtgcaatcatagcccactgcagccttgatttcccaggctcaagcaatcctcccaccgcagcctctcaagtagctgaaactacaggcacacaccaccatgcctagctcatgttttttttgaagttattagtagagatggggtcttgatatgttgcccagctggtctcaaactactgggctcaagtgatcctcctgccttggcctcccaaagtgctgggatgacaggcctggcccactgtcctcacttccaacaccacgggtcccttttgcctggttgaatataattgcagctgtaccctaggatcatcaggggccacccgagtctgtgtcagtccgtactgtcacatggccacagactatctcatggctgggacagtcacagtttattcccccaggcccttgggactgaaagaatccaagatctggatctcctctatagcgcccagaaccacagccaccgtcctgaagcacacggccttcacacgtttctacacgaagggagttttctgtcctgcttccttggacacagcaataatcagggagcagttgtcttgacctatgatgagggggtgaccggccatccctgggcatgggatggggagtgtgggtgggggctggctgtgggggctccgcgcctggatgtgatgttgaaattttgtgttgctttaaccgcctttactttctgagctaggggctgtctccatccatagcaaaagtgtaactttgttgtagatgggcgtaagcctcaccctggagagcgctagtaagtacagaccaggtgaaccagatcccagcctggaccccaccctgtcatgcccatctccccaaccccagagttccctccgtagcaggggacagggagggtgtgaggcaagcttgggctcagcacaggtcctggggtgggggctcgggctggccaaaaaaaatcagccccctctggattgggggtcctcatgtgggggtctctcggccctatggggagctgggagcttcctaaacttgtgtccaaatgactagtttcccaggggtgggtccgttcccatcaatcctcaaaggagagcctggcaccccaagattttaagagcctgagctataaatgacaagacttgggacactgggccacagttcctctcccagagagcaagggctcgtcacagactgaggggtactgaggggtcagaaacaaagtggggagaggcctctgcccacattggtgggagaagctgagttgacctaagcctgacattccccagccggctggacttgggcattcaccagtgtctgtgatctgcaaagacttcacaacactacccaggtggcactgagtatccaacctgggaagggacagctccatgtcacatcagttctactcacacagccctcttagtgccagtgttggggctgcaggaggaacagagatccccccagaggccccagaacattgaagggagagcagcaaacctcgcatcaaggtgttggccaagaactgggcctccagggtgggagggtgcttcgggccaatcttgaagcattggcttccagctgttgaggtcctgggggtactgagatggtacttgtttcctaacaaaacattttttataagtgcattcaccaatagagggcccacctattctggtggagagaattggaaaaggttccagaatccgggcagaagcctggctgttcccggtgagggctctcccttgctagcactccctcccaccctcactctgagcaacacagctgctcatgtccctggagaggacagctttggccaagttgttaaacatctctgagcctgtcttcccatcttggaaatgggggcagttgtcccaatgccgagataattgagtgtgaagccctcccctgtcccatgctgcctagtaccgaaggcacttgctctgtggccctggctgtaagaatgatcatttctgagtcagacctagggaaccagcccctgagaatgtgacttgacctagtttactcccaccgcccgctctgcaactctgagcctcctattgagcaaagataagctcataggcaacaaagagcactttgacatggaagaggttctgggccactgggctcggaggcagcggggcctgaccagcgccccaggccccagagctgctgacgtgggtccccaaggaggttgttggctgttctcttgccaccactctattaactcataactgctgttctcacgagaggctactggcagagaccaggcaggagctcctggagccaaggtcattgcttttatttttatttatttatttattgagatggaatgttcctttctcgcccaggctggagtgcagtggcatgacctcactgcatcctctgcctcacgggttcaagcaattctcccacctcagcctcctgagtagcagggattacaggcgtatgccaccacactaggctaattttttttacagacacgatttcgccacgttggccaggctggtcttgaactcctgacctcaagtgatccacccacctcagcctcccaaagtgttgggattacaggcgtgagccactgcacctggccaggctcatcactttttgcgcctattgcctcgaagccagtctctgatgggacattagggcaggggcccttcagcctagtctgggacatgggccgctcactcagcagtatgacaagcatcacctggagaacgggccagtctcaggaggtcgttcatgccccactggcagtgcactgtgcagccatagtgtaaacaagaggcttaacctgaattggtctgagatcttggggaccccctaccctgtctccagcagcctgtccctttagctgtttgcctactggcaccccatcctgagaaggcatagatacccggcccaccctgccctggaattacaaaagtcttagactgtgcctgagtgcccggcctccttgggagaccctcctaggcagcctaagcaccagacccgggagctgggtgctctggtcctgcctgcctgcctctcactggaccctctccttccaggtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaactggggaccctgcaccctccgggaagccatggagtctgctggaggcaccatatcagcctgcgggactagggtggggagcaaacaggccagcggtggaggtctggacagttcaagtgtgatgcagctgtggcaaggagaaatccttccgcctctgggcctcaggctgcctgtccataaaatggggacatggccagctgacggacaactgagtctccggcccacctaccaccgccagccaggatcccccaaagtgtgcagagggctcagcagagaacagtatgggaccccctcaccaggcctggaacacctccagccacaaagaagccaaaggtcagtccctctgctccccagcaaacggtgcctcccaggcattctcagtgccagggcttcatccctgtgaaggcacagggcctgctagtgggcacaggggtggctagttggggcctggggcagaggagggctgcaccaggcgtcctggggaatgtgctcagtgaagacgacactgggctttgcacagcctggtgtcgctgtacagaaactgtcaagggaataaagtgttctttgttttttaa

SEQ ID NO: 6233 - DNA, 960 bp, Homo sapiens
agcaataatcagggagcagttgtcttgacctatgatgaggggatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataa

SEQ ID NO: 6234 - DNA, 1540 bp, Homo sapiens
tttgtgttgctttaaccgcctttactttctgagctaggggctgtctccatccatagcaaaagtgtaactttgttgtagatgggcgtaagcctcaccctggagagcgctagtacggcttcaggtccagagcgtggagaagcctcagtaccgcgggacgttgcactgcttcaagtccatcatcaagcaagagagcgtgctgggcctgtacaagggcctgggctcgccgctcatggggctcaccttcatcaacgcgctggtgttcggggtgcagggcaacaccctccgggccctgggccacgactcgcccctcaaccagttcctggcaggtgcggcggcgggcgccatccagtgcgtcatctgctgccccatggagctggccaagacgcggctgcagctgcaggacgcgggcccagcgcgcacctacaagggctcgctggactgcctcgcgcagatctacgggcacgagggtctgcgtggcgtcaaccggggcatggtgtccacgttgctgcgtgagacgcccagcttcggcgtctacttcctcacctatgacgctctcacgcgggcgctgggctgcgagccgggcgaccgcctgctggtgcccaagctgctgttggcgggcggtacgtcaggcatcgtgtcctggctctctacctatcctgtggacgtggtcaagtcgcggctgcaggcggacggactgcggggcgccccgcgctaccgcggcatcctggactgcgtgcaccagagctaccgcgccgagggctggcgcgtcttcacacgggggctggcgtccacgctgctgcgcgccttccccgtcaacgctgccaccttcgccaccgtcacggtggtgctcacctacgcgcgcggcgaggaggccgggcccgagggcgaggctgtgcccgccgcccctgcggggcctgccctggcgcagccctccagcctgtgacgctcaccccgccctccttccccagggctccttctcagaaacctgggacataaattggcccctgagtcgattgccctgcttcctgctgggatgctgcgagctgtggagtctatcagacgtgggctgaattttgctgatcagctgggtagttttggccgagaactgcacttgcctcagtgttctcatctatgaaataaggaccctcatgcccacactgtagagtcacgaagctcagagattattcccagcagcagccagcacctggcctggctgaggccattgcaccgttatcctggaaactgaggcagacactccagcccctttctgggatcctggccacgtcattgtgctcctgccctgcaggctggctcccgggggtctctgatggccaaccaaggggccacccagggacctctaactccacacatcctccacccgggggggtggtgggccacccctctggtctgtgttagggacagaggaaaacttggtgtgcctcctggtgtcacagaactggatcctctgcataccccagcttctccacatgccactgctaggggtaccccagctgctgccactcctgctggagggtgaact

SEQ ID NO: 6235 - DNA, 1301 bp, Homo sapiens
gccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgaagttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaa

SEQ ID NO: 6236 - DNA, 4638 bp, Homo sapiens
gctttcagcctctggtgaagggcggcgcgcttaggcaggcggtggcgcggctggagtgccgcggggagggctgtgccggttgctttctgcagccgcatctcggccagctctcctcgccgtccccggggcgctgtgcgtctccagtccgggaccgaagccgcctgccgtagcgggcggccagatccgcgtcccgcctcagcggccggaggacatgcgggagagagaatgagccagagggacacgctggtgcatctgtttgccggaggatgtggtggtacagtgggagctattctgacatgtccactggaagttgtaaaaacacgactgcagtcatcttctgtgacgctttatatttctgaagttcagctgaacaccatggctggagccagtgtcaaccgagtagtgtctcccggacctcttcattgcctaaaggtgatcttggaaaaagaagggcctcgttccttgtttagaggactaggccccaatttagtgggggtagccccttccagagcaatatactttgctgcttattcaaactgcaaggaaaagttgaatgatgtatttgatcctgattctacccaagtacatatgatttcagctgcaatggcaggttttactgcaatcacagcaaccaaccccatttggcttataaagactcggttacagcttgatgcaaggaaccgcggggaaaggcgaatgggtgcttttgaatgtgttcgtaaagtgtatcagacagatggactaaaaggattttataggggcatgtctgcttcatatgctggtatatcagagactgttatccattttgttatttatgaaagtataaaacaaaaactactggaatataagactgcttctacaatggaaaatgatgaagagtctgtgaaagaagcatcagattttgtgggaatgatgctagctgctgccacctcaaaaacttgtgccacaactatagcatatccacatgttgtaagaacaagactacgtgaagagggaacaaaatacagatctttttttcagactctatctttgcttgttcaagaagaaggttatgggtctctttatcgtggtctgacaactcatctagtgagacagattccaaacacagccattatgatggccacctatgaattggtggtttacctactcaatggatagcagcacgaggactgctgtactgcaaaaaaagaagaccaaaagattacagtggaccatgggatacagaagccagcatggcagacagaagaaaaatagtttgggaacatgtaactattctaagtggaagttttgttgtaggaattatagtaatcacaccacattacttggcctttcggtaatgtgaaaaaaaaaaaaaacctcagagcctccaaggaaatgcctttagaagcactcctctctcaaaattgccattttctctaccatgtcccccagacacagttgggttttgttgatttatggcagtcttctaaacaaagccatccttaattttacatactgtattgtaactatccaaagatagtattggcagtcataaatttataacttctggcctttgtttaattccagtaaaataacagcaatgacaatgagatcgtcagtattattttcacatttccctgagaggacctggcacaatattttaaatttaattatttggcagtagtcactgtttttgacaaccaatgaaatagcgtctaaatatcttgtatattttttagcatcaaaatgttttggtttccactgctgacaggtgcttgttgtttagcctaatgtggatatttaaattgttaacataccaaacacacatggtaatagtttgggacaaaataactagtaaaatgttgatttctcggctttttcactgactgcggcatgtcctcgtgtcttctctgattttgtggtacatgaatgaatgcatttatctttttagtgacttactagttacgaacttgaattatcacctctttgtcatacttaagtatcatttacataaagtgtaaaagattttttcacttttgaatctttacctacttgctttcacattaagaatttgaacttttgagttttttccaggtctatatataatagattacatttattttgtaaagaaaatagtaatttaaagttttgccattttaaggtgacaatatttgggacagtataaatattatagacaagggcccccttgctgtctgctttagcaggtagtgacattaattgacttatagttttgtgtaaatgaacaaactgcttttgacaagaaatttattctgtcctagtttcctgcgtggtaaatcatagaaagattcaagttcatttgggttaaatgtgctaataggatgtagcttttaaattctgctattgagtcagctgtaccttttaatactttaaatgtgttatttgtatggcccttataaaggtgtttgctgtaattctgttaaaagacttcgcctatgccatactggtgtataaaaactgccgcaattggacgccggtgtggtactcatttcagtatacctgaactgtacattttgtgcaatggctttatctaaaagaatgacgcttcgtgaaagcactttgtggccttttttgggggggagggtgagagagtaggagagaataccatgttaagattaaaaaaaaaaacaaaaacattggtcacgtattaggcagaaacagtgttcataacatttttctgggttttaaatatgttgtttcggatatccttaatataaatgttttaggtattctgtgtaccctgtcgtacccccaacattatagaatattgcagcgtgtcattgcaagctttctctgctgtcaccagtgaaacatagtgccctgttaaattcccccactttaacttccttgtgatcaacagtaactggatgtttttgaggtgctcaattggaataaaaatattccaatctatttggagaccaaaggcaaaatcagttttcttacctttggaattattcgtaccttttatggtaaatttcagctttgacatgtattatgaggaacgtaccaaaaaccggtttgtaacaaatctgtagagaaggtctgaatctatcgtgtttgccttttcaggtgccatttctactgcctaatacagtgccatttgccttgtgaagacccataaacattcattgtgttgaatgtaagatagagactctccctagtcttactgatctcagtaccccacaaatgattaagaatgatatgaaaaccagcagctaaggaacatcttattatttagttgtagcatattcataacaagtgtccttcaaggataaacatatattctctatttgtatttagcaagtaaaacttgtgttgacctttagtgcattatattcagcttttaacagtattatgtatgtactggaaagcaaagaaatcttagagtcttggacattgtttatttgtgcaacaactagaaaggagcaatgaagtttatttcagttgtatttttccctaagcacaatctgcaatagtttatgtatgacagagataattcaaaaaggaaaactatatataaaagttgtatataaagtttgtctctgaaatatttctttgaagtttttaaaaaatcgactcatgtttaaaaacaaaaacacatattcagagcattggacttttttaacttgttttcatctgtttatcatgacttttttatttctggtgtagagtccacattatttagtttgttgtacttttaaatttcaaagttcaaatctgaagaattagcgtttgtgatttcgggataccatgcagtggttttaatcccaggaaaaaaactatcaccaaaagttcgtttgattctcattatgtaactttgtagaaccatcctttctagatgggtccaccacagtgaatttgtaactttgaagtcaggatagaatatcattagattatctgtgagatagcattactatgttaggaccagcagagtttgggttggtaaaaataatgtttgctctattactgggttacagacatttcagcatttttaggttggttttaaatcactaaaaatatttattcggatttgaaggatttaagtgctaaaaatcaatccatttcttgcccttcaataattgtccatgcctgccttttgttgtttacatgctcttctgcccagactgttagtaatctagggaccccctttggagctgataagtacagttcagccttttctcctcaaatatataatgactttaacattcctaagaatataggtatttctgaatgatttaaatttgaggaattttaatacataaaatacaatgtacaaactttctgcccactcagatctcttctccatcatgtacttagtatttcccattaacctacacactgatttttatgctactccttgtagaaacaaaattctggtttgactcagtttttgtgtttataaacttttggaatgtgtaccccgtttatgtgaagaattatgacctatcagtcatagctaaatagtgaacctcaaaagtgttaacttttgactattcatgtgaggtttggtatcttgcatttatgtacatggctgtaaattatgtgcatttactctgtatttatgttatctagctgacttttacttgaattgttcaaattttaaaaattaaaatacgctca

SEQ ID NO: 6237 - DNA, 1738 bp, Homo sapiens
gagctgttgaggccaccctggtggcaccaaagccctctcaggcaggcagacccagggcctccccgccacaccttgttcatggattttgtcgctggagccatcggaggcgtctgcggtgttgctgtgggctaccccctggacacggtgaaggtcaggatccagacggagccaaagtacacaggcatctggcactgcgtccgggatacgtatcaccgagagcgcgtgtggggcttctaccggggcctctcgctgcccgtgtgcacggtgtccctggtatcttccgtgtcttttggcacctaccgccactgcctggcgcacatctgccggctccggtacggcaaccctgacgccaagcccaccaaggccgacatcacgctctcgggatgcgcctccggcctcgtccgcgtgttcctgacgtcgcccactgaggtggccaaagtccgcttgcagacgcagacacaggcgcagaagcagcagcggcggctttcggcctcggggccgttggctgtgccccccatgtgtcctgtgcccccagcctgcccagagcccaagtaccgcgggccactgcactgcctggccacggtagcccgtgaggaggggctgtgcggcctctacaagggcagctcggccctggtcttacgggacggccactcctttgccacctacttcctttcctacgcggtcctctgcgagtggctcagccccgctggccacagccggccagatgtcccgggcgtgctggtggccgggggctgtgcaggagtcctggcctgggctgtggccacccccatggacgtgatcaagtcgagactgcaggcagacgggcagggccagaggcgctaccggggtctcctgcactgtatggtgaccagcgttcgagaggagggaccccgggtccttttcaaggggctggtactcaattgctgccgcgccttccctgtcaacatggtggtcttcgtcgcctatgaggcagtgctgaggctcgcccggggtctgctcacatagccggtccccacgcccagcggcccacccaccagcagctgctggaggtcgtagtggctggaggaggcaaggggtagtgtggctgggttcgggaccccacagggccattgcccaggagaatgaggagcctccctgcagtgttgtcggccgaggcctgagctcgccctgcccagctactgacctcaggtcgaggggcccgccagccatcagccagggttggcctagggtggcaggagccagggaggagtgggcctctttgatgagagcgttgagttgcatggagtcggttgttcatcccagcctccccatggccctcgcctcccatgtctttgaagcacccctccagggagtcaggtgtgtgctcagccaccctctgccccattcctagaccctcacccccaccactgttcctgtgtcttcacgagctgtcccttacaggcaggggcttcccacaggctgggggcctcggggcggggagcatgagctgggctggcaccacgactgagggctcccggctcggcttcttccccacagcaggctgctcagagggggtgctgccgggactgccatgcccacctgagaggggcctggggtggccgtcctcggccggttagggaatttggggtgaggttcctcaggagccctcactctgcctgtggacgctgcacctgccacttaaagaccccaaagactctgttgggaactgttgtcaataaaatgtttctgaggatgttca

SEQ ID NO: 6238 - DNA, 1880 bp, Homo sapiens
agcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggtaagggcagcagcagctggagccgcacccctgtgcaggccacagcagtgggacagctggggaactgccatgcccttctcagcccagggggagggcaggacacatttaggtactcacccaacaattctttgttaggtacctactctgtccccggccctctcccacctcagtctcatcccttccctatgcagctatgagaatggcagttcccatttgactttcaggcaacagatatattttgaacacatactctgtgtcaggcattactaagctttggaaaggaaatccattatcatggttcagtttattaaatgcaatctttgtaatgtaaggatgccattagttctacaaggtaggaatcggtttccccatttcacagatgagaaaactcaggtccagaaatgttaagtagccaatcccaggtcatacagctggagctgacagtatagcaggactctgcagtcagaaagatttaagttcaaatccacacttcatcattttgtgaccatggacttgttgcttaacctccctgctcagaatcctgcaccacatccttctttcatttaaggtaaaagttgatatctttgcaatggttttccaggccctcagtgatctagctccctgttccccacccacctcacttctactcctctccccttcctcactttctccagtcacactggtctctgctgcaacttgaccatgcctggcccttccctgaccacagggcctttgtacctgctactcaccacctcctgaatttaacaacgtggagaccactggggattttggcaagggccatttgatggagagaagggtgtaaaaacctgatgaagtgggataaagaaagaatgggatgaaggatattggtgcacccaagtatacacaactcttctgagggttctgctatgctgtaatgaggaacagagaaacagagccatagccagaagggcctttggaagccaagagaggatactttttaagaaggctgacatcatgacatgtttgatgtgatgggaaagatctaac

SEQ ID NO: 6239 - DNA, 1148 bp, Homo sapiens
cctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacggaggtgaacacaggatgactacagtgttccctgggcctcatctctgcatgtgaagccctgagagctgcagatgtttggcctttggacctccaagtggacatcaattagcaagcgtgggctaggatggtgcagacactgacgtggcccttctgatgcctgggatgcctcatgagtcactgattcaagccctccaaggttctgatccccaatgcccactctgctaggctggcatcaaagagctttccaagaaatgtttggtccagctgagaagtcctgaccatgagcaccagggagccagaaaccacccagagaaacgttgcttcactcctctgtctgaggatggggaggggccagtgagctctgggctcagccactccctccagtctcaagtaacacgtccccgtgcctccagtctcctctcagcaccgaccaggtttttccccgctcctgcacccgtggatcctgaggacagcggtagcgccttcctcaccgcacgctgagtccagtgcgtgctcctcactgtgcacttattagtgtctgttgagtgattaaatcacatcctcaggtctgcagcaaataaatgaaagtttctttattttttattaa

SEQ ID NO: 6240 - DNA, 1108 bp, Homo sapiens
agcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggagcaatttcttgggggacagcgactcctatggatgtcgtgaaaagtcgactccaagctgatggggtttatttaaacaaatataaaggtgtcctggactgtatctcccagagttaccagaaggaaggtcttaaagtgtttttcagaggcatcactgtgaacgcggtgcggggcttccccatgagtgcggccatgttccttgggtacgagctgtcgctgcaggctatccgcggggaccacgcagtgacgagcccataa

SEQ ID NO: 6241 - DNA, 1111 bp, Homo sapiens
gtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgcagccagtgtcatcgttggccaccctctggacacagtcaagactcgcctgcaggctggcgttggctacggaaacaccctcagctgcatccgcgtggtgtacaggagggagagtatgttcggcttcttcaagggcatgtccttccccctcgccagcattgccgtctacaactccgtggtgtttggggtcttcagtaacacgcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacgccaacctcggtttgaagtccagggcagtggctcctgcggagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgccgtgtggctggcgggcggcatggcaggagcaatttcttgggggacagcgactcctatggatgtcgtgaaaagtcgactccaagctgatggggtttatttaaacaaatataaaggtgtcctggactgtatctcccagagttaccagaaggaaggtcttaaagtgtttttcagaggcatcactgtgaacgcggtgcggggcttccccatgagtgcggccatgttccttgggtacgagctgtcgctgcaggctatccgcggggaccacgcagtgacgagcccataagcgccaggtcagtgtgcttccatcctggccaattgtgcctc

SEQ ID NO: 6242 - DNA, 3660 bp, Homo sapiens
accactgcctgcaggttggcgccaccacccccactctccccgctgctcgcgggagccagagggccctgcggtcctcggtggtcttgccagcccctcgtcatcccagggccctccgcgcctgtgaggactccctcagcgtgcaaacagcaggctcagcccaggctccagggtgtcctgggcacctggtgtcctgggagcaaagtctttgcctaacgtcgctgagaagaatgtttaaagtgaaagtacattggagtctgcaaacaggacagacccgaggcctcacgtgggaccagtcaggcctctaagcaccgcctccctaacgccacggtgttttccgagatcaagggaaaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtgggacctcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgtgcctctgtaaggggctctgggacgcccagaccctgcccgccgcccacctggtggtgacaagctccagcagccagtgggtccggacctgcttgatgccgcggtgagggacggcgcccacataggcgaggttgagctgctggtcccagctgaggacgtactggtcagcctggctgtgtggcagcggggggctggggacaacaaaggggcggctcagtcccgagcctcagcatggctggcagcgcggctgacacacacgttcaagcccaggactgcccgggcgcaggatccaggcgctgcccgtgcgttcagtgactaataaaatgacccttagggccaggaa

SEQ ID NO: 6243 - DNA, 3109 bp, Homo sapiens
acagaccactgcctgcaggttggcgccaccacccccactctccccgctgctcgcgggagccagagggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccaggtcctcatgggcgtcctccggctgggcttcgtgtccgcctacctctcacagccactgctcgatggctttgccatgggggcctccgtgaccatcctgacctcgcagctcaaacacctgctgggcgtgcggatcccgcggcaccaggggcccggcatggtggtcctcacatggctgagcctgctgcgcggcgccgggcaggccaacgtgtgcgacgtggtcaccagcacggtgtgcctggcggtgctgctagccgcgaaggagctctcagaccgctaccgacaccgcctgagggtgccgctgcccacggagctgctggtcatcgtggtggccacactcgtgtcgcacttcgggcagctccacaagcgctttggctcgagcgtggctggcgacatccccacgggtttcatgccccctcaggtcccagagcccaggctgatgcagcgtgtggctttggatgccgtggccctggccctcgtggctgccgccttctccatctcgctggcggagatgttcgcccgcagtcacggctactctgtgcgtgccaaccaggagctgctggctgtgggctgctgcaacgtgctacccgccttcctccactgcttcgccaccagcgccgccctggccaagagcctggtgaagacagccactggctgccggacacagctgtccagcgtggtcagcgccaccgtggtgctgctggtgctgctggcgctggcaccgctgttccacgacctacagcgaagcgtgctggcctgcgtcatcgtggtcagcctgcggggggccctgcgcaaggtgtgggacctcccgcggctgtggcggatgagcccggctgacgcgctggtctgggcaggcaccgcggccacctgtatgctggtcagcacagaggccgggctgctggctggcgtcatcctctcgctgctcagcctggccggccgcacccaacgcccacgcaccgccctgctggcccgcatcggggacacggccttctacgaggatgccacagagttcgagggcctcgtccctgagcccggcgtgcgggtgttccgctttggggggccgctgtactatgccaacaaggacttcttcctgcagtcactctacagcctcacggggctggacgcagggtgcatggctgccaggaggaaggaggggggctcagagacgggggtcggtgagggaggccctgcccagggcgaggacctgggcccggttagcaccagggctgcgctggtgcccgcagcggccggcttccacacagtggtcatcgactgcgccccgctgctgttcctagacgcagccggtgtgagcacgctgcaggacctgcgccgagactacggggccctgggcatcagcctgctgctagcctgctgcagcccgcctgtgagagacattctgagcagaggaggcttcctcggggagggccccggggacacggctgaggaggagcagctgttcctcagtgtgcacgatgccgtgcagacagcacgagcccgccacagggagctggaggccaccgatgcccatctgtagcagggccaggcctgcccagcagcctctgctccctcctggggacccacagcagacgtctgcaagccactgctgagacccttcccagggaggagccacccaagagctgcactcttgtgccacagctgccctggggaaaccggggaaccccaactgggaaaggaggccctctgatcacacgcaggacccaaacactcagaaatcaagaacctctgcctccgagacaggctggcccacagtgctggctgggccccaatgcaccgtccctcagctcaggagggatgggcctgacctgacgctcagggttgacatcttatttgaacaagggtcccccgccatcatgcagcctccaaggtgccaagaggactccctatgcccaggcctgcccggtgcccaccctgctggtaggagccagcggctctggccaagtgcacgagggtctctgtgtttccagaaggccccacacacccaagtgcccctcacacctcgtgcctccccctcacagggtggccacctgcaccagcgtcagggcccagggtgctgtgaccgatgagacctcagctcagccctcaggtgcagtggccctacccagcctggccagcagacacacacagggatgctcacgggtgcaccaggagccaggtgcggcgcagccaaccctgagcctgcagggagacctgcaggaagcccaccgtgccccatgcaggggctccctccagcacacagccctcaccccagcacagccagcaaggacacgctctccccaacagggtgcttcggcgggaggtgggggaacaaggggtcttccgagcagcccccagccctcccctcccatctgt

SEQ ID NO: 6244 - DNA, 1111 bp, Homo sapiens
gggccctgcggtcctcggtggtcttgccagcccctcgtcatcccagggccctccgcgcctgtgaggactccctcaggtcggccacgggacctgacgcaacaggatggacgagtcccctgagcctctgcagcagggcagagggccggtgccggtccgacggcagcgcccagcaccccggggtctgcgtgagatgctgaaggccaggctgtggtgcagctgctcgtgcagtgtgctgtgcgtccgggcgctggtgcaggacctgctccccgccacgcgctggctgcgtcagtaccgcccgcgggagtacctggcaggcgacgtcatgtctgggctggtcatcggcatcatcctggtgccgcaggccatcgcctactcattgctggccgggctgcagcccatctacagcctctatacgtccttcttcgccaacctcatctacttcctcatgggcacctcacggcatgtctccgtgggcatcttcagcctgctttgcctcatggtggggcaggtggtggaccgggagctccagctggccggctttgacccctcccaggacggcctgcagcccggagccaacagcagcaccctcaacggctcggctgccatgctggactgcgggcgtgactgctacgccatccgtgtcgccaccgccctcacgctgatgaccgggctttaccagacgtcctggggtagaaacagcttccagcaacacccatggcaattaacacagaggagtgactcgcaggaacttctggaagaggaggaaagatcttgctgatttaacaggaaatgccgacatcaacgacatcgagaatgcgggaccctcacaccagcctcacgagaagccggtggatacagcttattccagagggaggcttggatcagcacctggggaaaaaaggcagcccctcaacctggccagcctgcagaggagagaagcctgagcaagcgtcctccaaatttcacaacaggctttaccatgtggatgatgtaaccagtcatcagtacatttctgtaaagcaaagcacacttttaaaaaccagccatgctagtgggcctgaggattacctttcgtcttcctctttcctctgtggaagatgatattgcaaaa

SEQ ID NO: 6245 - DNA, 2515 bp, Homo sapiens
cacaagctctagagggcttccgggaggaggcttagggagctgggaatccgggagcagatggtgggttcctaccgtcgagggtgggagagagggatctgaggccaagtttgaggtaaggactgtggagctccatcagatccccatccccacctcccctcatctgcgcaatcctgcgagaagccttagacaggttctggctcagagaaccggagagaggcacaacgcctggcccccaggacttggccacagcgtccctgaccttgtctgctccatgacctctcactgaggcccattaacccctcagttccctgatgaggcttgatttagcatccttgatgtcagctcctaagagtctgggaagtgcatttaagtcctggaggttggacaaggccccctccccacagcacacctttccatccacttctatcccaggcatggcttttgctctcctggcctccgtgcccccggtgtttggactctacacttctttcttccccgtcctcatctacagcttgctaggtactgggagacacctgtccacaggaactttcgccatactcagcctcatgacaggctcggccgtcgagcggctggtgccggaacccctcgtggggaatctgagcggaatcgagaaggagcagctggacgctcaacgggttggggtagccgcggccgtggccttcgggagcggggcgttgatgctggggatgttcgtgctgcagctcggcgtcttgtccacctttttgtccgagcctgtggtcaaggcgctgaccagcggggccgcgctgcacgtgctcttgtcccagctgccgagcctcttggggttgtccctcccgcgccagatcggctgcttctctctcttcaagacgctggcctccttgctgactgcgctgcctcggagcagtccggccgaactgaccatctccgcgctcagcctggcgctgctcgtgccggtcaaggaattgaacgtgagattccgagaccggctacccacgccgatcccgggggaagtcgtcttggtgcttctggcctccgtgctctgcttcacctcttctgtggacacaagataccaagtccagatagtggggctgttgcctggaggatttccccaacccctcctccccaacctggctgagctgcccaggattctggctgactcgctgcccattgcactggttagttttgcggtgtctgcctccctggcctccatccatgcagacaagtatagctacactattgactccaaccaggagttcctggcacatggtgcctccaacctcatctcctccctcttctcttgctttcccaactcggctacgctggccaccaccaatctactggtggatgctggtgggaaaacacagctggcaggcctcttctcctgcacagtggtcctgtcggtgctgctgtggctggggcccttcttttactatctgcccaaggctgtcctggcttgcatcaacatctccagcatgcgccaggtgttctgccagatgcaggaacttccacaactatggcacatcagccgagtggactttgctgtgtggatggtcacctgggtggcagtagtgaccctgagtgtggatttgggcctggctgtgggtgtggtcttctccatgatgactgtggtctgccgcacccggagctcctccaggtcccggggctctgcatcctgagctatccaacaccactgtactttgggacccgtgggcagtttcgctgcaacctggagtggcacctggggctcggagaaggagaaaaggagacttcaaagccagatggcccaatggttgcagttgctgagcctgtcagggtggtggtcctagacttcagtggtgtcacctttgcagatgctgctggggccagagaagtggtgcaggtgagggagaggctggccagccgatgtcgagatgctaggatccgcctcctcctggctcagtgtaatgccttggtgcaggggacactgacccgggtaggactcctggacagggtgactccagatcagctgtttgtgagtgtgcaggatgcagctgcttatgccctggggagcctgttaaggggcagtagcaccaggagcgggagccaggaggcactgggctgcggcaagtgaggcaggggtaagtggctggagacccagggagaggggtttgggaaagggtctgaggaagatcaagaagaaaagggtggggacggaatgaatagtagattgaagaccaaatcagggagcccgggctgagctatgggtgaggaactgaagaactcagatccctaagtaggtggggtacccctgagaggactgccacatttcattaaggaagaggggtgcctaatctattcctgacatgtctcctctcttctccaggagctcactgacccaaagatttgcaccgtgtgggtctgacctcatcatgtggagtgcagagggccctgatgacatgtgtgtgatgaggaccatgacccttgaacccccttacctaacgtaactaataaaatgaagctgagagctttggaatcc

SEQ ID NO: 6246 - DNA, 2885 bp, Homo sapiens
tccccggcgattcctgcggacccagctgcggcgacgccaggagaccccaagctgcatcgccgagtggaagcaactagaactccagggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaa

SEQ ID NO: 6247 - DNA, 2918 bp, Homo sapiens
acgtgcgcgccagaccccgccccggcctgtccccggcgattcctgcggacccagctgcggcgacgccaggagaccccaagctgcatcgccgagtggcaactagaactccagggctgtgaaagccacaggtgggggctgagcgaggcgtggcctcaggagcggaggacccccccactctccctcgagcgccgcagtccaccgtagcgggtggagcccgccttggtgcgcagttggaaaacctcggagccccgctggatctcctggctgccacccgcaccccccgccagcctacgccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaagattttt

SEQ ID NO: 6248 - DNA, 2851 bp, Homo sapiens
acgtgcgcgccagaccccgccccggcctgtccccggcgattcctgcggacccagctgcggcgacgccaggagaccccaagctgcatcgccgagtggagccgttcgcccccctggggaggggagacccatagtgacctctcctgacacccgccgaccctgaccagtgttgccgggttcttcaaaggccacgctctgactgctggtctgtgtcacctgcaccccccagccccaccgtagagatgccttcttcggtgacggcgctgggtcaggccaggtcctctggccccgggatggccccgagcgcctgctgctgctcccctgcggccctgcagaggaggctgcccatcctggcgtggctgcccagctactccctgcagtggctgaagatggatttcgtcgccggcctctcagttggcctcactgccattccccaggcgctggcctatgctgaagtggctggactcccgccccagtatggcctctactctgccttcatgggctgcttcgtgtatttcttcctgggcacctcccgggatgtgactctgggccccaccgccattatgtccctcctggtctccttctacaccttccatgagcccgcctacgctgtgctgctggccttcctgtccggctgcatccagctggccatgggggtcctgcgtttggggttcctgctggacttcatttcctaccccgtcattaaaggcttcacctctgctgctgccgtcaccatcggctttggacagatcaagaacctgctgggactacagaacatccccaggccgttcttcctgcaggtgtaccacaccttcctcaggattgcagagaccagggtaggtgacgccgtcctggggctggtctgcatgctgctgctgctggtgctgaagctgatgcgggaccacgtgcctcccgtccaccccgagatgccccctggtgtgcggctcagccgtgggctggtctgggctgccacgacagctcgcaacgccctggtggtctccttcgcagccctggttgcgtactccttcgaggtgactggataccagcctttcatcctaacaggggagacagctgaggggctccctccagtccggatcccgcccttctcagtgaccacagccaacgggacgatctccttcaccgagatggtgcaggacatgggagccgggctggccgtggtgcccctgatgggcctcctggagagcattgcggtggccaaagccttcgcatctcagaataattaccgcatcgatgccaaccaggagctgctggccatcggtctcaccaacatgttgggctccctcgtctcctcctacccggtcacaggcagctttggacggacagccgtgaacgctcagtcgggggtgtgcaccccggcggggggcctggtgacgggagtgctggtgctgctgtctctggactacctgacctcactgttctactacatccccaagtctgccctggctgccgtcatcatcatggccgtggccccgctgttcgacaccaagatcttcaggacgctctggcgtgttaagaggctggacctgctgcccctgtgcgtgaccttcctgctgtgcttctgggaggtgcagtacggcatcctggccggggccctggtgtctctgctcatgctcctgcactctgcagccaggcctgagaccaaggtgtcagaggggccggttctggtcctgcagccggccagcggcctgtccttccctgccatggaggctctgcgggaggagatcctaagccgggccctggaagtgtccccgccacgctgcctggtcctggagtgcacccatgtctgcagcatcgactacactgtggtgctgggactcggcgagctcctccaggacttccagaagcagggcgtcgccctggcctttgtgggcctgcaggtccccgttctccgtgtcctgctgtccgctgacctgaaggggttccagtacttctctaccctggaagaagcagagaagcacctgaggcaggagccagggacccagccctacaacatcagagaagactccattctggaccaaaaggttgccctgctcaaggcataatggggccacccgtgggcatccacagtttgcagggtgttccggaaggttcttgtcactgtgattggatgctggatgccgcctgatagacatgctggcctggctgagaaacccctgagcaggtaacccagggaagagaaggaagccaggcctggaggtccacggcagtgggagtggggctcactggcttcctgtgggatgactggaaaatgacctcgctgctgttccctggcatgaccctctttggaagagtggtttggagagagccttctagaatgacagactgtgcgaggaagcaggggcaggggtttccagcccgggctgtgcgaggcatcctggggctggcagcaccttcccggctcaccagtgccacctgcgggggagggacggggcaggcaggagtctgggaggcgggtccgctcctcttgtctgcggcatctgtgctctccgagagaaaaccaaggtgtgtcaaatgacgtcaagtctctatttaaaaataattttgtgttttctaaatggaaaaagtgatagctttggtgattttgtaaaagtcataaatgcttattgtaaaaaatacaggaaaccacccctcaccctgtccacttgggtgatcattccagacccctccccaaacatgcatatgtacctgtccgtcagtgtgtggatgtatgtttacagttctacataaatgggatcattttatacatggtgctctggaacccacatttttcatgcagtcatttgcagtgaattatttattgtgataataaatagcattagaatacaagattttt

SEQ ID NO: 6249 - DNA, 5263 bp, Homo sapiens
gaatataaggggaattactggcgagagagctgtagaccaacttaacactgaacccattacttttccaagaccagaaaaaaatattacatgaacaggaactacttctccttcagataagaattcaagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttgacattggtctgttttgctgtgaatattggaaatgcttaggatcttcagacccaatagctctaattttaacatttctacccaataagaggctctgttttccactgaagctttgttggagaaagagaatatgaaaattacacattttataatttttagatgagaaaataccactagcagaatagctttgtgctattccagtataagatgaactgtaataatttttgacttccctatttcagagatagtcaatataatatgtttatctatatccatatggatggataggtaggtagatcttcatagatttttttttcttttgttagaggagagcttgatgtgattatcttcaaacccaccaaaccaacaggataattgacaaataaacgccataggctaggctgaactgtatgttactgttttcatgcttatacatatattttcaatcacatacaagtacatagaatttcacattttaatttagcaaattgatttacctaggaaaaaattatcaccttcaaagataggcatagacacataattatgcttaagcttttaacagcattttaaccgctctaaaaattaccagagtaagaaaaagctaggtactttaaagtgagtttgagaaacaagttgaaactaaaattaaaataccagccatttaggtgctttctctggcatctataaaagtaaattctagtgcctgccaagtgatggattataatggtctctagcaaatgtgtggtaaacattcatatggccattaattttaacattaaatcgtaggtagggcaatgtagtaaaatgaaagagaattaagaaaggttttgaattcttataacatatccagccatttcaattttgattgaaatgaactacaaagaatagtgtttgtccctatggtagcctcagtctctttatcactaacttggattgaaatgagtgaggccaactcacattcccatcaaacactcttccaaggaaaagcagaagtaataattggaggtaaagtttccttagagaaaataattttattctgctttgtccaattaaattattccaatggcggatggtaatattcaccatctctaattcattggtcactggtaggtaagcatgagttaaggaaagtcaaaaatgaaaatatattttgctgtgtataaattgatattttgctatgcaactcctgtaattgaatttgtataatgcaggcactttctaatttattagagattatggatcagttctgacattaaaatcatagttaattgatggatggtttttatagtttgttgataaagtggacacagtattgtctgagcagttatattttaatgcatttcagtgtttatagtagaagtttagtggataaaactttaagtccaataacttgggggtcaaatgctaatgttttattcaatgtaaaggaagaccaaaccatgtaccttatgaagacctttgttttaagacttccacacaccaaggctacaatgactgttaacctggaggaagtctctggtatggagttctgagagcttaagagctaaacatgagtttagacacacaagattctaaaatgcaaatgtttattttgaagcaggcattgacaacacaaaaactgtgtagtggtcttgatgctggattgtttctagagtcacaatgaattatttttatgagattaccttatttttatatatgacaaactacttctataatgcttattatggtaaaataaaattggaaaaaattaaaactgacctataagagtgttaaggacctaatagagtgacatatataaattaagcataaaatatgtaaccaggaaaagactgttaacattacatttatgcaaattaaatgcccttaaatttcaccatttgtctttcattttaaaggttatttgctcccgattatatgattcaagtgttataagttttagcttgaactactttgcagtaatttatttgacagatctctattctataaatgtgtaatgtgatgaagaaagagatctttcttttttaatgaaaacattaatgtgttaataccctgtatggataatgcttgacatttagtggtttccaaaatatattagtatattgttgaacatacattatgccttagaaatgcacattctgtattttgtgggatgataatctaattcagtatagaatatgctgtttggcaatgagtttgtggccagatttcaaatagggagttaagtggtactttcacaatccaaagatttttagttaaaaatcatgtagtctaatatgctgcagttatttttttatatttttcaatgcatttaattatcttttttataattctttgtactaactcagcatgtaacaaccaatttacatggaaataaatcgaaatatgataactattatgc

SEQ ID NO: 6250 - DNA, 2656 bp, Homo sapiens
ggcgagagagctgtagaccaacttaacactgaacccattacttttccaagaccagaaaaaaatattacatgaacaggaactacttctccttcagataagaattcaagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataaggccagttataaactgttgtttgataacttggatcttccaacaatgccaccgctctgaggattgggtggttgcctatcatttgcaaactgcttacttgtacaacaaatgcttcttccaggatctactgtcctggggacttgaatccacctttctcaaatataaaaactctaaatatggccttttaagttttttctgctctgatatcttgcctctaagcttatattgccatctttggaaatactatttgtagaatctagtgctcacatgatctgaagtgtcaaagttattttacaaatgctgggcttatggtttagttttacaactgttcttagagctttaatttcctgcaatttttccttgagttttgaattgttttgcctttcctcacccctagaataacatttggtgcctcgcagagtcatccctattgtatacaatcagaacagtatgtatttacaaaataataataacactattattattaaatctaacatatattga

SEQ ID NO: 6251 - DNA, 818 bp, Homo sapiens
tgaagccagcaagtcttgactaatctccaagcaatgtagctgtaaaaggactggaagataagcaagaatctgaagctggtgcctctccaagtattaatttgttcttacaaatgttttactcaacgtgaccctaacctctttggaattgctcaggtgtagaacagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatcc

SEQ ID NO: 6252 - DNA, 2902 bp, Homo sapiens
ccagcaagtcttgactaatctccaagcaatgtagctgtaaaaggactggaagataagcaagaatctgaagctggtgcctctccaagtattaatttgttcttacaaatgttttactcaacgtgaccctaacctctttggaattgctcaggtgtagaacagctttgacattgtaaaccacagacgaattggagcttggcattgaaaggaggtgttctgcaatgattttttttcttgtttagagaagtttacttctacaagaagaaatctgaaaaatgacaggagcaaagaggaaaaagaaaagcatgctttggagcaagatgcataccccccagtgtgaagacattatacagtggtgtagaaggcgactgcccattttggattgggcaccacattacaatctgaaagaaaacttgcttccagacactgtgtctgggataatgttggcagttcaacaggtgacccaaggattggcctttgctgttctctcatctgtgcacccagtgtttggtttatatgggtctctgtttcctgccataatttatgccatatttggaatgggacatcatgttgccacaggcacctttgccttgacatccttaatatcagccaacgccgtggaacggattgtccctcagaacatgcagaatctcaccacacagagtaacacaagcgtgctgggcttatccgactttgaaatgcaaaggatccacgttgctgcagcagtttccttcttgggaggtgtgattcaggtggccatgtttgtgctgcaactgggcagtgccacatttgtggtcacagagcctgtgatcagcgcaatgacaactggggctgccacccatgtggtgacttcacaagtcaaatatctcttgggaatgaaaatgccatatatatccggaccacttggattcttttatatttatgcatatgtttttgaaaacatcaagtctgtgcgactggaagcattgcttttatccttgctgagcattgtggtccttgttcttgttaaagagctgaatgaacagtttaaaaggaaaattaaagttgttcttcctgtagatttagttttgattattgctgcatcatttgcttgttattgcaccaatatggaaaacacatatggattagaagtagttggtcatattccacaaggaattccctcacctagagctcccccgatgaacatcctctctgcggtgatcactgaagctttcggagtggcacttgtaggctatgtggcctcactggctcttgctcaaggatctgccaaaaaattcaaatattcaattgatgacaaccaggaatttttggcccatggcctcagcaatatagtttcttcatttttcttctgcataccaagtgctgctgccatgggaaggacggctggcctgtacagcacaggagcgaagacacaggtggcttgtctaatatcttgcattttcgtccttatagtcatctatgcaataggacctttgctttactggctgcccatgtgtgtccttgcaagcattattgttgtgggactgaagggaatgctaatacagttccgagatttaaaaaaatattggaatgtggataaaatcgattggggaatatgggtcagtacatatgtatttacaatatgctttgctgccaatgtgggactgctgtttggtgttgtttgtaccatagctatagtgataggacgcttcccaagagcaatgactgtaagtataaaaaatatgaaagaaatggaatttaaagtgaagacagaaatggacagtgaaaccctgcagcaggtgaaaattatctcaataaacaacccgcttgttttcctgaatgcaaaaaaattttatactgatttaatgaacatgatccaaaaggaaaatgcctgtaatcagccacttgatgatatcagcaagtgtgaacaaaacacattgcttaattccctatccaatggcaactgcaatgaagaagcttcacagtcctgccctaatgagaagtgttatttaatcctggattgcagtggatttaccttttttgactattctggagtctccatgcttgttgaggtttacatggactgtaaaggcaggagtgtggatgtattgttagcccattgtacagcttccttgataaaagcaatgacgtattatggaaacctagactcagagaaaccaattttttttgaatcggtatctgctgcaataagtcatatccattcaaataagaatttgagcaaactcagtgaccacagtgaagtctgagacccttttgtcacagtacagctcttgtctttaccaactgcctgaagaggccatatgctggcattttgcacaactttttggttgtttagatcctacagatgacctctgctacaataagtacgatgtgacttagtaactgcatagcagttggaaagaactgccaacttttttttctcatttttgttagtaagaagattcgcttagttattttatgtaaaaatcagtatgtgtttagttttagtgtactgaagggtaaacatggttttattttattttaccatattattttgtgttgttttatttctattgtgctgtaagttgatgtttaaaattgagaaatacttttgtcataggtaatttggaacatttacaagccatttgtaaaattttaagataatctgtaactaatacataaaaacaacttagcaaatgtgccattttcacacaacttctctctgtataggcctctgaaatatcaataaggctaaatattactttacacagtaagatgtgaaattcacaaaaagtaaaccaaacaaaacgaatgaaaaactggaaataattcgtttccatatctttccatacatccatttctgaagtattcaggaatgttttcataatcgaaagaaacgggtatccaaataaaaccaagttcttga

SEQ ID NO: 6253 - DNA, 3463 bp, Homo sapiens
ggtatccgcgtccgcagcgccgccagccaggcgagagccgtgtgggatcccagcgcccgcactcccgcccccgccaaggagccaggtgagccgctgctgggagacgcctgggcgccgggggctgcaggtcccagggcgggggctgcgtccgtcaccggcaggtacccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactct

SEQ ID NO: 6254 - DNA, 3144 bp, Homo sapiens
gctgggagacgcctgggcgccgggggctgcaggtcccagggcgggggctgcgtccgtcaccggcaggtacccaggtatgccgcagagccaggcacgccgtgggcactcagtcagtatctgtggaatgaatgaatgatggtcgtccctgggagcttatctctgaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactcta

SEQ ID NO: 6255 - DNA, 3653 bp, Homo sapiens
tgttcaggacacgaggcctggcaccaaataggccctcgatcaagaatagcaaaacctcggagagagaaggagccttggtatacaggtttaccaaataccaaggggatcccacgactcaggtatgaggagggcgacccaggtaccactttcctggctccctagcccagctgctcatgctcctcttcctcgtcccctcccccactctcatctcctcagcccgcccggaacgcccgcgggctaggccacaacggctcgggaaccgccgccggtatccgcgtccgcagcgccgccagccaggcgagagccgtgtgggatcccagcgcccgcactcccgcccccgccaaggagccaggaatggcacaactagagaggagcgccatctctggcttcagctctaagtccaggcgaaactcattcgcatatgatgttaagcgtgaagtatacaatgaggagacctttcaacaggaacacaaaaggaaggcctcctcttctgggaacatgaacatcaacatcaccaccttcagacaccacgtccagtgccgctgctcatggcacaggttcctacgatgcgtgcttacaatctttcccttcctagaatggatgtgtatgtatcgattaaaggattggcttctgggagacttacttgctggtataagtgttggccttgtgcaagttccccaaggcctgacacttagtttgctggcaaggcaactgattcctcctctcaacatcgcttatgcagctttctgttcttcggtaatctatgtaatttttggatcgtgtcatcaaatgtccattggttccttcttcctggtgagtgctctgctgatcaacgttctgaaagtgagcccattcaacaacggtcaactggtcatgggatctttcgtcaagaatgagttttcggccccctcctaccttatgggctataataaatccttgagtgtggtggcaaccacaacttttctgactgggattattcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgattattggcttcactgtgattgcaaacaagataagcatggccacagaaaccagccagacgcttattgacatgattccttatagctttctgcttcctgtaacaccagatttcagccttcttcccaagataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagacaacagtttgcatctctggtaggcgcaggtgtgatgctgctcctgatggtgaagatgggacactttttctacacactgccaaatgctgtgctggctggtattattctgagcaacgtcattccctaccttgaaaccatttctaacctacccagcctgtggaggcaggaccaatatgactgtgctctttggatgatgacattctcatcttcaattttcctgggactggacattggactaattatctcagtagtttctgctttcttcatcaccactgttcgttcacacagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccattaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacagatatgcaatgcctttcaaaacgccaacattttgatactcattgcagggtgtcactcttccatagtcagggcatttgagaggaatgatttctttgacgctggcatcaccaagacccagctgttcctcagcgttcacgacgccgtgctgtttgccttgtcaaggaaggtcataggctcctctgagttaagcatcgatgaatccgagacagtgatacgggaaacctactcagaaacagacaagaatgacaattcaagatataaaatgagcagcagttttctaggaagccaaaaaaatgtaagtccaggcttcatcaagatccaacagcctgtagaagaggagtcggagttggatttggagctggaatcagaacaagaggctgggctgggtctggacctagacctggatcgggagctggagcctgaaatggagcccaaggctgagaccgagaccaagacccagaccgagatggagccccagcctgagactgagcctgagatggagcccaaccccaaatctaggccaagagctcacacttttcctcagcagcgttactggcctatgtatcatccgtctatggcttccacccagtctcagactcagactcggacatggtcagtggagaggagacgccatcctatggattcatactcaccagagggcaacagcaatgaagatgtctaggagatgaactagaaataaggggtcagataatgctggcaaatcctcctacccaaaaaggggtcaattgtccagagacctagactggatacgaactagcagtacttccttcctgactgtgactcctactacctgccagccttcttccttgctctgcgctgggatcatactcccaaatcacattactaaatgccaacaattatctctgaattccctatccaggctcccctcatttcaccttcagcatatattctagtcatgaatttccttcttcacacaccccacatctctgggctttgtgccagaccatctctaacttaatcctctcatccctgttcccctttctccaaagagatgaagctcaaataaaatgtataactctagtaaca

SEQ ID NO: 6256 - DNA, 4510 bp, Homo sapiens
atatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaa

SEQ ID NO: 6257 - DNA, 4616 bp, Homo sapiens
gagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtg

SEQ ID NO: 6258 - DNA, 4799 bp, Homo sapiens
gagcagagccctttcacacacctcaggaacacctttcggctgcccgctccccagacacacctgcagccctgcccagccggctttgctcacccactgcttgtaaatgccccagatatgagccagcccaggccccgctacgtggtagacagagccgcatactcccttaccctcttcgacgatgagtttgagaagaaggaccggacatacccagtgggagagaaacttcgcaatgccttcagatgttcctcagccaagatcaaagctgtggtgtttgggctgctgcctgtgctctcctggctccccaagtacaagattaaagactacatcattcctgacctgctcggtggactcagcgggggatccatccaggtcccacaaggcatggcatttgctctgctggccaaccttcctgcagtcaatggcctctactcctccttcttccccctcctgacctacttcttcctggggggtgttcaccagatggtgccaggtacctttgccgttatcagcatcctggtgggtaacatctgtctgcagctggccccagagtcgaaattccaggtcttcaacaatgccaccaatgagagctatgtggacacagcagccatggaggctgagaggctgcacgtgtcagctacgctagcctgcctcaccgccatcatccagatgggtctgggcttcatgcagtttggctttgtggccatctacctctccgagtccttcatccggggcttcatgacggccgccggcctgcagatcctgatttcggtgctcaagtacatcttcggactgaccatcccctcctacacaggcccagggtccatcgtctttaccttcattgacatttgcaaaaacctcccccacaccaacatcgcctcgctcatcttcgctctcatcagcggtgccttcctggtgctggtgaaggagctcaatgctcgctacatgcacaagattcgcttccccatccctacagagatgattgtggtggtggtggcaacagctatctccgggggctgtaagatgcccaaaaagtatcacatgcagatcgtgggagaaatccaacgcgggttccccaccccggtgtcgcctgtggtctcacagtggaaggacatgataggcacagccttctccctagccatcgtgagctacgtcatcaacctggctatgggccggaccctggccaacaagcacggctacgacgtggattcgaaccaggagatgatcgctctcggctgcagcaacttctttggctccttctttaaaattcatgtcatttgctgtgcgctttctgtcactctggctgtggatggagctggaggaaaatcccaggtggccagcctgtgtgtgtctctggtggtgatgatcaccatgctggtcctggggatctatctgtatcctctccctaagtctgtgctaggagccctgatcgctgtcaatctcaagaactccctcaagcaactcaccgacccctactacctgtggaggaagagcaagctggactgttgcatctgggtagtgagcttcctctcctccttcttcctcagcctgccctatggtgtggcagtgggtgtcgccttctccgtcctggtcgtggtcttccagactcagtttcgaaatggctatgcactggcccaggtcatggacactgacatttatgtgaatcccaagacctataatagggcccaggatatccaggggattaaaatcatcacgtactgctcccctctctactttgccaactcagagatcttcaggcaaaaggtcatcgccaagacaggcatggacccccagaaagtattactagccaagcaaaaatacctcaagaagcaggagaagcggagaatgaggcccacacaacagaggaggtctctattcatgaaaaccaagactgtctccctgcaggagctgcagcaggactttgagaatgcgccccccaccgaccccaacaacaaccagaccccggctaacggcaccagcgtgtcctatatcaccttcagccctgacagctcctcacctgcccagagtgagccaccagcctccgctgaggcccccggcgagcccagtgacatgctggccagcgtcccacccttcgtcaccttccacaccctcatcctggacatgagtggagtcagcttcgtggacttgatgggcatcaaggccctggccaagctgagctccacctatgggaagatcggcgtgaaggtcttcttggtgaacatccatgcccaggtgtacaatgacattagccatggaggcgtctttgaggatgggagtctagaatgcaagcacgtctttcccagcatacatgacgcagtcctctttgcccaggcaaatgctagagacgtgaccccaggacacaacttccaaggggctccaggggatgctgagctctccttgtacgactcagaggaggacattcgcagctactgggacttagagcaggagatgttcgggagcatgtttcacgcagagaccctgaccgccctgtgagggctcagccagtcctcatgctgcctacagagtgcctggcacttgggacttccataaaggatgagcctggggtcacagggggtgtcgggcggaggaaagtgcatcccccagagcttgggttcctctctcctctccccctctctcctcccttccttccctccccgcatctccagagagagcctctcagcagcaggggggtgctacccttacaggagtgagagtctggtgagcccactcttcacccgtcaggccctggccgcaatggacaagcctcctgctcactccaccccacccacctctgccctgtccttggcagctgaaggacaccttgacttccagcttttacgagtgagccaaaaacagaaggacaagtacaactgtgctggcctgctgtacaagcttcaaaaagtgtcccagagcccacacggctcggtgtcagatggtgtcaggctgtcacggacatagggataaacttggttaggactctggcttgccttccccagctgcctcaactctgtctctggcagctctgcacccagggaccatgtgctctccacacccaggagtctaggccttggtaactatgcgccccccctccatcatccccaaggctgcccaaaccaccactgctgtcagcaagcacatcagactctagcctggacagtggccaggaccgtcgagaccaccagagctacctccccggggacagcccactaaggttctgcctcagcctcctgaaacatcactgccctcagaggctgctcccttcccctggaggctggctagaaaccccaaagagggggatgggtagctggcagaatcatctggcatcctagtaatagataccagttattctgcacaaaacttttgggaattcctctttgcacccagagactcagaggggaagagggtgctagtaccaacacagggaaaacggatgggacctgggcccagacagtcccccttgaccccagggcccatcagggaaatgcctccctttggtaaatctgccttatccttctttacctggcaaagagccaatcatgttaactcttccttatcagcctgtggcccagagacacaatggggtccttctgtaggcaaaggtggaagtcctccagggatccgctacatcccctaactgcatgcagatgtggaaaggggctgatccagattgggtcttcctgcacaggaagactctttaacacccttaggacctcaggccatcttctcctatgaagatgaaaataggggttaagttttccatatgtacaaggaggtattgagaggaaccctactgttgacttgaaaataaataggttccatgtgtaagtgttttgtaaaatttcagtggaaatgcacagaaaatcttctggcctctcatcactgcttttctcaagcttcttcagcttaacaaccccttccctaacaggttgggctggcccagcctaggaaaacatccccatttctaacttcagccagacctgcgttgtgtgtctgtgtgttgagtgagctggtcagctaacaagtcttcttagagttaaaggagggggtgctggccaagagccaacacattcttggcccaggagcattgcttttctgtgaattcattatgccatctggctgccaatggaactcaaaacttggaaggcgaaggacaatgttatctgggattcaccgtgcccagcacccgaagtgccaaattccaggaggacaagagccttagccaatgacaactcactctcccctactccacctccttccaagtccagctcaggcccaggaggtgggagaaggtcacagagcctcaggaatttccaagtcagagtcccctttgaaccaagtatctagatcccctgaggacttgatgaagtgatccttaacccccaagtaatcattaacccccagaccagcctcagaactgaaggagattgttgacccagtgacctggagttgaggctcagggagagatctgccacatgtctgagggttgcagagcccgctgtggaggtaagattggaaacacatgaggcagagggaagacattgaagaaaacatctctgctggaatatttggaaaagaacactcttctggacctggttgaagcaggaaagatggaggcaaagtagtgaaataatccagaatttcaatgcttttgaatgttcttagtgatactgacctgtgataatataattcccagggaggactgggaaccttatctcttgagatatttgcataatttatttaatttaagcctcattctccttttgttcattttggtaataaactggatttgaattgtgaacaaa

SEQ ID NO: 6259 - DNA, 3219 bp, Homo sapiens
gggcctcctccctggggtgtgagcaggtcggcgcgccacacttctctaggtggccggacgcgcgcccagggaggagctggcggcggggcccaggctgttccggctgcggcacgccaggggatgtggttagccctgagcctggaggccgaaggtgggcaggcaacactcccaccatgtttcggaggagaatacactaggctagcctaacgacactcggagtgcgagctgcggctggggtaggggcacccctttccagcgggcgcgtgggtcaccaaggagcagttctccgggacccgttgcgtcagagggactgggcggggctgggcggggcaggacgggggcggcgctcaggaaccctggaacccgctggccctgaggccacggaccgagacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggtctggaaagtcctggggaactcgcagggcacgggccgctgtcgcggttgggaggcgagggcgcagcgctggggttgtagattccaagacccctgagggtggctgtgttggtttctcgcaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttact

SEQ ID NO: 6260 - DNA, 2616 bp, Homo sapiens
gacgtggtgctgagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggtttgtttagggtcgcagaagcagggaggactgactcagccctcacagagaagaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaagatttttatatctagaactttcatatgctttcttaggaagagtgagaggggggtatatgattctttatgaaatggggaaagggagctaacattaattatgcatgtactatatttccttaatatgagagataattttttaattgcataagaattttaatttcttttaattgatataaacagtagttgattattctttttatctatttggagattcagtgcataactaagtattttccttaatactaaagattttaaataataaatagtggctagcggtttggacaatcactaaaaatgtactttctaataagtaaaatttctaattttgaataaaagattaaattttactgaaatatttta

SEQ ID NO: 6261 - DNA, 2294 bp, Homo sapiens
gagcccctgcgcggtttctggtgcgtagagactgtaaatcgctgcgcttctcagtcatcatcatcccagcttttcccggctcgaattcagcctccaactcaagctcgcgggaaagactacctgagaggagaaaagcttctgtccctggaccttcttctgagggtggtgaggagtcggaggctccctgctttccagccgcccagtgacccaagcttaatcttcagcaccacttggggcgaccttttcggtgcaaacctacgattctgtttctcaggattcctccccatcccgcttcgccccggaaaagctgacaagaacttcaggtgtaagccctgagtagtgaggatctgcggtctccgtggagagctgtgcctggaagagaaggacgctggtgggggctgagatcagagctgtcttctggcccagttgcccccatgcttctgtcatggctaacagttctaggggctggaatggtcgtcctgcacttcttgcagaaactcctgttcccttacttttgggatgacttctggttcgtgttgaaggtggtgctcattataattcggctgaagaagtatgaaaagagaggggagctggtgactgtgctggataaattcttgagtcatgccaaaagacaacctcggaaacctttcatcatctatgagggagacatctacacctatcaggatgtagacaaaaggagcagcagagtggcccatgtcttcctgaaccattcctctctgaaaaagggggacacggtggctctgctgatgagcaatgagccggacttcgttcacgtgtggttcggcctcgccaagctgggctgcgtggtggcctttctcaacaccaacattcgctccaactccctcctgaattgcatccgcgcctgtgggcccagagccctagtggtgggcgcagatttgcttggaacggtagaagaaatccttccaagcctctcagaaaatatcagtgtttgggggatgaaagattctgttccacaaggtgtaatttcactcaaagaaaaactgagcacctcacctgatgagcccgtgccacgcagccaccatgttgtctcactcctcaagtctacttgtctttacatttttacctctggaacaacaggtctaccaaaagcagctgtgattagtcagctgcaggttttaaggggttctgctgtcctgtgggcttttggttgtactgctcatgacattgtttatataacccttcctctgtatcatagttcagcagctatcctgggaatttctggatgtgttgagttgggtgccacttgtgtgttaaagaagaaattttcagcaagccagttttggagtgactgcaagaagtatgatgtgactgtgtttcagtatattggagaactttgtcgctacctttgcaaacaatctaagagagaaggagaaaaggatcataaggtgcgtttggcaattggaaatggcatacggagtgatgtatggagagaatttttagacagatttggaaatataaaggtgtgtgaactttatgcagctaccgaatcaagcatatctttcatgaactacactgggagaattggagcaattgggagaacaaatttgttttacaaacttctttccacttttgacttaataaagtatgactttcagaaagatgaacccatgagaaatgagcagggttggtgtattcatgtgaaaaaaggagaacctggacttctcatttctcgagtgaatgcaaaaaatcccttctttggctatgctgggccttataagcacacaaaagacaaattgctttgtgatgtttttaagaagggagatgtttaccttaatactggagacttaatagtccaggatcaggacaatttcctttatttttgggaccgtactggagacactttcagatggaaaggagaaaatgtcgcaaccactgaggttgctgatgttattggaatgttggatttcatacaggaagcaaacgtctatggtgtggctatatcaggttatgaaggaagagcaggaatggcttctattattttaaaaccaaatacatctttagatttggaaaaagtttatgaacaagttgtaacatttctaccagcttatgcttgtccacgatttttaagaattcaggaaaaaatggaagcaacaggaacattcaaactattgaagcatcagttggtggaagatggatttaatccactgaaaatttctgaaccactttacttcatggataacttgaaaaagtcttatgttctactgaccagggaactttatgatcaaataatgttaggggaaataaaactttaa

SEQ ID NO: 6262 - DNA, 2839 bp, Homo sapiens
ggggccgggcggactcggggaccggcggaggacgccgggcgcgcccggcccgaggctgggggagcggggcggcgtggcgggcgcgccgaggaccccaggccgggccgggccgagcagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgca

SEQ ID NO: 6263 - DNA, 2880 bp, Homo sapiens
tggtggcctgggctgtgctcgtcgccgcgctcgtggaccggggccgggcggactcggggaccggcggaggacgccgggcgcgcccggcccgaggctgggggagcggggcggcgtggcgggcgcgccgaggaccccaggccgggccgggccgagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggaccaggcctacgccatcaacctggccgctgtgggcaccgtggccttcggctgcacagtgcagcaatccagcttctacgggtacacggggatgctgcccaagcggtacacgcagggggtgatgaccggggagagcacggcgggcgtgatgatctctctgagccgcatcctcacgaagctgctgctgcccgacgagcgcgccagcacgctcatcttcttcctggtgtcggtggcgctggagctgctgtgtttcctgctgcacctgttagtgcggcgcagccgcttcgtgctcttctataccacacggccgcgtgacagccaccggggcaggccaggcctgggcaggggctatggctaccgcgtgcaccacgacgttgtcgccggggacgtccacttcgagcacccagccccggccctggcccccaacgagtccccaaaggacagcccagcccacgaggtgaccggcagcggcggggcctacatgcgctttgatgtgccgcggccaagggtccagcgcagctggcccaccttcagagccctgttactgcaccgctacgtggtggcgcgggtgatctgggccgacatgctctccatcgccgtgacctacttcatcacgctgtgcctgttccccggcctcgagtctgagatccgccactgcatcctgggcgagtggctgcccatcctcatcatggctgtgttcaacctgtcagacttcgtgggcaagatcctggcagccctgcccgtggactggcggggcacccacctgctggcctgctcctgcctgcgtgtggtcttcatccccctcttcatcctgtgcgtctaccccagcggcatgcccgccctccgtcaccccgcctggccctgcatcttctcactgctcatgggcatcagcaacggctacttcggcagcgtgcccatgatcctggcggcaggcaaagtgagccccaagcagcgggagctggcagggaacaccatgaccgtgtcctacatgtcagggctgacgctggggtccgccgtggcctactgcacctacagcctcacccgcgacgctcacggcagctgcctgcacgcctccaccgccaatggttccatcctcgcaggcctctgagccagccccgcccactgccagggacgccgagggcctgaccaggggccccgaggcctgagggcccctcccctgtccccacctcagtgcctgcggggccctgagcctccccctgtgccagcagccccactccctcagggtccagccatgccccaccctggactgaagttctgcaaagtcctccgaggaccggaacacgtttctgcgacccggggctctggccagcactgtgttctgcgtttggtctcatacctgcgtctaccttccatctgtgtccagcggccccggctccagcccagccagcactctgcagggtcacacgcaccgtgtccccacccaggacagcagacacccgccagagtgtgcgcgcccagtgactgcaccccggccctcatcacccaccggcactgatcggggcaccgcctggcccagcctccaccagggacccctcctcatgaactctggagccctgagaggagaggggcagccccccaccttgtcaccctcagggcttccccttctgtcctcattcttagagactgcttctcccaaacataacgcgttagccatgaaggagtcggagccctgggtccgaatggacccgcctgcggtctgcatcagcctctgggaaaccacagcagtgatgccagctgggcacgtcaggacctccccacacacccacacgatgccacaggtcagggggctgtgcctgactagggagccctcccattgccttcctggcccgggatagaagaggggaggtaagtctgggggctacgaagccgggcccccacaccctggctgaagtcagcttgacctaggtcttgaccctcatccagcaagggactcgacagacccaagggtccctggaacgtagggaggggctgggggtcagtccagcccgggcctcccagaacaccaggcccgtgtgggtggcaccctgaggtcaggggatcctaagggtgtccttccagagacggtgtttccagggggaggaccgcccccgcttccagatccccggccccggctgtgactgccctgtttcacccctgctgtgtcccatcccccgtctgtccactaactgtaccgcaccggccattaaaagatgaaggcagaccgctgcaccgcc

SEQ ID NO: 6264 - DNA, 623 bp, Homo sapiens
acagcctcctcttgtaaatagagagtacaaaggcttctccgagtagtgtgtatgccgggcagacgctgatgccacggggagaggccttagaaggagcacaggaaagtcccaggtaagaaccagcagaggctgccatgggctccgtggggagccagcgccttgaggagcccagcgtggcaggcacaccagacccgggcgtagtgatgagcttcaccttcgacagtcaccagctggaggaggcggcggaggcggctcagggccagggccttagggccaggggcgtcccagctttcacggatactacattggacgagccagtgcccgatgaccgttatcacgccatctactttgcgatgctgctggctggcgtgggcttcctgctgccatacaacagcttcatcacggacgtggactacctgcatcacaagtacccagggacctccatcgtgtttgacatgagcctcacctacatcttggtggcactggcagctgtcctcctgaacaacgtcctggtggagagactgaccctgcacaccaggatcaccgcaggctacctcttagccttgggccctctcctttttatcagcatctgcgacgtgtggctgcagctcttctctcgggac

SEQ ID NO: 6265 - DNA, 3295 bp, Homo sapiens
acttccgctacctccacggcaggcgtcgctaaatgacgttgccgtttccgggtcacccaggcagcttgtggcggcgaagccatcggtgttcgctgatgtccagtctatggagtcagttggtaccggtggcggcgcggaggcagaaggcggtgtccgagtaggggcctctgccccaccaggatgttacccggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacatggttccctgtagtcatccatatattggtaccctgagtcaagtaaagttgtactccacaaatgttcagaaagaaggacagggatcacaaacactcagagtggaaaaagtaccatcatttgaaacagcagaaggtataggcacagaactcaaagctccacttaagcaagaacctctccaagtaagagttaaagcagtccttaagaaaagggagtatggctcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccatagggaacattttggttatttaaattgttcataatgtcccatatttcacctgttcagtgtatactgtactttgcaatcatctttccttttttcacattggtaaaaataagtggcatccataggatcatgatttttaatttgttgcctctgaagatttcactccatcaagatctgccaatcttcaatattctggctaaatcttggtatgtggtttttaaacagtcactccgtttcaaagtctgtctttccttatagaatgtggaaattatttctccataccttgtgattttgacctgagtgctaagagaatcactctccttacctagttatctacaaatgttcattccagaaatgtttagttactgaattgaatgaagacatctcagtacactcttttaggtcatagtagttgccattttgtaaaatttcttttttcttctttgcttttttccccttatttggtttaatttttctaatgttaggagatatagtcctagatatttccatgggccagtgtgatgacttttttttaaatgaggttcagtaccataatgtttatttactggaagataatgcatttataagcattttaaaattctgtaaagtgggttagaaatatttataattttacaggcaggacagcatttgacttttatttaaaaggcggcactacttatgtaaatctgagctgtgggatatttcttgctttaagagagagacagaatctctcactgaaactcatggtcatgattttgtataatatagttcatactgtgtctgtgagtttcttcagttacaaatgggcatttagtatagttatattgactataacatgtaagtaaatagctttctactgaccctaagttatcaaggtggaaaaaaaacatgcaattcagtaattgaaaatgtggtgaaaagctgcagctgtcatcatcaaaacaactcataacatactttaaaatgttcaggtagcagtgagcattgttcatatgagaatggcggctgggtgatctctttgctgaattaatgagttcttaacatgtggacccaactgcctgtgtgagatctgtgtcttaaaacttactggaatggaaatctatgaattattgcaaattgtaatgctggaaacaaaaaataaatccttggttaaagggtttgtaatggtga

SEQ ID NO: 6266 - DNA, 2187 bp, Homo sapiens
aggcagcttgtggcggcgaagccatcggtgttcgctgatgtccagtctatggagtcagttggtaccggtggcggcgcggaggcagaaggcggtgtccgagtaggggcctctgccccaccaggatgttacccggcttggccgccgccgcggcccacagatgtagctggtcctccctgtgccggctccgtctgcgatgcagggcggcggcctgtaatcccagcgaccgccaggagtggcagaatttagtgacatttggaagcttttcaaacatggttccctgtagtcatccatatattggtaccctgagtcaagtaaagttgtactccacaaatgttcagaaagaaggacagggatcacaaacactcagagtggaaaaagtaccatcatttgaaacagcagaaggtataggcacagaactcaaagctccacttaagcaagaacctctccaagtaagagcccaagaaaggaataatggcaaataagaatcatcaattgcattatcatttttagaagagtaaggcaattaaagaacaagaggcccacacttttcagctactgcttattcaaatccagttaaagcagtccttaagaaaagggagtatggctcaaagtacactcagaataatttcatcactggagtcagagcgataaatgagttctgcctcaaatccagtgatctagaacaacttcgaaaaatcagacgacgaagtccccatgaagatactgagtcttttactgtatacttgagatcagatgtggaagcaaaatctttggaagtttggggaagccctgaagctcttgccagagaaaaaattgcgtaaggaagcagaaatagaatacagagaaaggctatttagaaaccaaaaaatattaagagaatacagagatttcttgggaaataccaagccacgctccagaacagcatcagtgttttttaagggaccaggaaaagtggtgatggttgcaatttgcatcaatggattaaactgcttctttaaatttcttgcctggatttataccggttcagcaagtatgttctcagaagctatacactcattatctgatacttgtaatcagggtttactagcattgggcatcagtaagtctgttcaaacaccagatccttctcatccgtacggattttcaaatatgcgctatatttcttcgctaattagtggtgttggtattttcatgatgggtgcaggactatcttggtaccatggagtcatgggattgcttcatcctcaaccaatagaatcccttctatgggcatattgtattttagcaggatcattagtatctgaaggagcaacacttcttgttgctgtaaatgaacttcgtaggaatgctcgggctaaaggaatgtcattttacaagtatgtaatggaaagtcgtgatcctagtacaaatgtgatattattggaggatactgctgcagtcttgggagttataatagcagccacttgcatgggccttacttctataacaggcaatccactgtatgacagcctaggttctttgggtgtgggcaccttattaggcatggtctcagcattcctcatctacactaacacagaagcactcttagggcggtccatccagccagaacaagtacaacggctcactgaactcctggagaatgacccatcagtaagggcaattcatgatgttaaagccacagatctgggattaggtaaagtaagatttaaggcagaagtagattttgatgggcgagttgttacaagatcatatttggaaaaacaagattttgaccaaatgttacaagaaattcaagaagtgaaaactcctgaagaactagagacctttatgcttaaacatggagaaaatattattgatactttaggagctgaagtagatagacttgagaaggaactgaaaaaacgaaatcctgaagttcgacatgtagatttggagatactgtgagtttgatggaatgaatcacctgggtggggaccttggaaacaagtttgtccgtccactctacaaagtttcctcctctcctacactgaaagactcagtgccatgcagaagccttttttttaagatgaaggaaatattttatgtaaagagcaactcagcaggacacagaactaaaactactacttacatctaacagacacactacaagttgaatcaatttgaaaatcatgtttttatgcttccata

SEQ ID NO: 6267 - DNA, 2574 bp, Homo sapiens
gctcgcgccccgcggcagctccgcagtgcactagccaccaccgccgccgccgccgctccgccagacctgctgccagcttgcccggtccagccctgagagagcctcgaacgccagctgcgagggtcatgagccagagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgccaggatgggttttcaggcggccacggatgaggaggcggtgggcttcgcgcattgcgacgacctcgactttgagcaccgccagggcctgcagatggacatcctgaaagccgagggagagccctgcggggacgagggcgctgaagcgcccgtcgagggagacatccattatcagcgaggcagcggagctcctctgccgccctccggctccaaggaccaggtgggaggtggtggcgaattcgggggccacgacaagcccaaaatcacggcgtgggaggcaggctggaacgtgaccaacgccatccagggcatgttcgtgctgggcctaccctacgccatcctgcacggcggctacctggggttgtttctcatcatcttcgccgccgttgtgtgctgctacaccggcaagatcctcatcgcgtgcctgtacgaggagaatgaagacggcgaggtggtgcgcgtgcgggactcgtacgtggccatagccaacgcctgctgcgccccgcgcttcccaacgctgggcggccgagtggtgaacgtagcgcagatcatcgagctggtgatgacgtgcatcctgtacgtggtggtgagtggcaacctcatgtacaacagcttcccggggctgcccgtgtcgcagaagtcctggtccattatcgccacggccgtgctgctgccttgcgccttccttaagaacctcaaggccgtgtccaagttcagtctgctgtgcactctggcccacttcgtcatcaatatcctggtcatagcctactgtctatcgcgggcgcgcgactgggcctgggagaaggtcaagttctacatcgacgtcaagaagttccccatctccattggcatcatcgtgttcagctacacgtctcagatcttcctgccttcgctggagggcaatatgcagcagcccagcgagttccactgcatgatgaactggacgcacatcgcagcctgcgtgctcaagggcctcttcgcgctcgtcgcctacctcacctgggccgacgagaccaaggaggtcatcacggataacctgcccggctccatccgcgccgtggtcaacatctttctggtggccaaggcgctgttgtcctatcctctgccattctttgccgctgtcgaggtgctggagaagtcgctcttccaggaaggcagccgcgcctttttcccggcctgctacagcggcgacgggcgcctgaagtcctgggggctgacgctgcgctgcgcgctcgtcgtcttcacgctgctcatggccatttatgtgccgcacttcgcgctgctcatgggcctcaccggcagcctcacgggcgccggcctctgtttcttgctgcccagcctctttcacctgcgcctgctctggcgcaagctgctgtggcaccaagtcttcttcgacgtcgccatcttcgtcatcggcggcatctgcagcgtgtccggcttcgtgcactccctcgagggcctcatcgaagcctaccgaaccaacgcggaggactagggcgcaagggcgagcccccgccgcgcttctgcgctctctcccttctcccctcaccccgcccccaccagcccagtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcggggccagcttgcctgccggttttcaggaatctaaactctcatcttgtgcaatttatcaggtgtggaactgttctactgtgcgtgtggtgtgctcgtggtgaataagatgaaatgtatatcagaaaaaaatctatctctaatttagagtgcggtacataattatatccgcaaataaagaagagacaaaggct

SEQ ID NO: 6268 - DNA, 5099 bp, Homo sapiens
ggcggccgctcgggcaggatggcggcggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaatttacagcaagtacgtacactggaatgaatgaggcaatcacgttacaccaaatcagcagatcaaaagacaaacacatatttctgagacttgaaggtccacatccccccgccccctgccaagatggagtcttgctttgttgctcaggctggagtgcagtggcgcagtctcagctcactacaacctccatcccccgggttcaggtgattctcgtgcctcagcctcccgagtagctgggattacaggcatgcaccaccacggctggctaattttttgtgtttttagtagagacagggtttcaccatgttggccaggctggtctcgaactcctggcctcaaatgatccgcccaccttggcctcccaaagtgctaggatgacaggcatgagccaccgtgcccagcctgattgacaatggcctcttgaaggctgggttttcccagccggacagtgcccgccccacatgctccactcccacgctttcatctgcaggcctgccttcctctcagccacctcactgctgagctctgtggtagagaatttcctttacccatcagggtatggtctggctggtaatactgactccaacccagctccttcattttatagaaggaggcatttctgaatcatgtttgttcaccatggcgagactcactgcagaatttttaaccaccttattttaagtcattcattctaggaacagtcaagcccctaccacaaaggggccagatccgttcaagtgaggaagcacttgcagtttctgaattttgctgtatatttgtcctatgtcacccaacaggccctttgctatagctgggacattaccagaccccaataccttagggtctcacagcctgaaggacacagagcattgaattattaaaagacctgaaaatattataatgtttttcaattgtcacctgttttcaagacttaaatgctatagacttttctgcaggaatgacgtgtatattcctcactggcatttaccaaaaataaatgatggtttccagggaatcaaaa

SEQ ID NO: 6269 - DNA, 1908 bp, Homo sapiens
gggagagctgccaggctgacggagaggccggcccgagtgggggccgctccgccgccgccgccgccgccgccgctgtgatgcggagccggtgctgcgccgggcggtggagtcagagcccgggcgcgggagcaggagctgcaagatcagcaccagcggctccggcacctgcaccagctcccgggccccgcgctgcgctctccgccccgccgcactcggggccgtcgccccgcgctctctatggatgtcaaggcggcccccaacggggtggccactatcgaggaccggatcctgcggatcaccggctactatggctattatccaggttactccagccagaaaagtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 6270 - DNA, 3041 bp, Homo sapiens
gtaaacgggcgtctggatccccgaatggttgcgtgtttccgtgtgtgggtccgggggaggcccacgaacgccagcgaaaccgctgacaccaccgcccaactatgaactcatcaggcgcctgaagaccgacacgccgaacatgcgccgcgcgcactcgcgcacgagtgagatcatcgcgccccggtcgtgagtgcgctcacacgcagcctgagactcgacgggagggggtcacgtggaagtatctgagagaggcgtacttggccactaggaaagcacctccccctttccaaaaatgctccggaagtgccttcgccctccgtaaagatggccggggcagtcggcacgagggaggcggggatgcgcctgcgcaacaagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagccatga

SEQ ID NO: 6271 - DNA, 1986 bp, Homo sapiens
aagttcggcggggaagatggcggatgacaaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccac

SEQ ID NO: 6272 - DNA, 3617 bp, Homo sapiens
cgtggtcttcactctccttgacctttttagttccggggagaagcgactctggagcggctcaggagtgaggatgtcccttgtttcttctgcggctcctgtcaactgcctcaacagtgtggagtggtgtggggagagcattcggcgaggcgggaggagccgtggatcccccagatgtcccctcctgggaaccatcacgaacccgttactagcacagactcaaaaacattcacccttaaacactcctcactttaccccattccctagctcccgaaattttcttcccagtgacacgatgtttccaatcacacggacactcacaccaccctcattcaaacactcctttgcatacattctgaatttcatacttatatgcgatcaaaatcactcagtccatttacttacacacttgccgacagtcttttttgtcattctcagtcacatccagtcactcacattcagtttgggatgtccttgggaagaaagaggtaaagcccatccaggaaccaagacaataaaattgtccaggaaactgcctcggtccattactcaccattggtctagaagctcagcattacccacacatttactaaatgtcaggcactagaacatagtagccaagacagactggtcacgactttcaaggagctcataatggagtcagtagtggtttcctgatggacctaattaaaggtccctagctgtccctcctgcctttcctacatactgcttgctatataaaattcttgtcaaggttgatgtaagttactggttcagatcccatctgtcagtcccttcctggccctcatttgaattctgtgcttttcaatgcttgtctttctttgccactgccatctcaggaagcttttataggaaaaggtctttctggctcaccccatcccctcccaattcccagcttctgatggaattgagcaaggggtggggcttagtcagactgctggagccagcctctcgcttgtcctaggattctctgcctaagcttaaggacctggcatttctcaagaaccagctggaaagcctgcagcggcgtgtagaagacgaagtcaacagtggagtgggccaggatggctcgctgttgtcctccccgttcctcaagggattcctggctggctatgtggtggccaaactgagggcatcagcagtattgggctttgctgtgggcacctgcactggcatctatgcggctcaggcatatgctgtgcccaacgtggagaagacattaagggactatttgcagttgctacgcaaggggcccgactagctctaggtgccatggaagaggcaggatgagcagctcagccttcaggtggagacactttatctggattccccagctgtcatccatttgctatctccaactttcctgccaccttcatccttgcctcccttcctgcagattgtggacagtagttcctcagcctgcaccctggattccttcttccccttcctagctccatgggactcgccccaagactgtggcttcaaggaccaccagccccttactcttcaagccctgactgtggagttggtagatgcctctgatcctcagtattctctctggcaatgttccacggcttctccttcctgggagctggctccataacttgattttccccaaacgtgttgcaatccctgctgccccttagccacccagggtcttgtgtgggtatgagtgtagaggatgggggtatgccaggcctgggccgtcccaggcaggcccgctggaccctgatgctactcctatccactgccatgtacggtgcccatgccccattgctggcactgtgccatgtggacggccgagtgcccttccggccctcctcagccgtgctgctgactgagctgaccaagctactgttatgcgccttctcccttctggtaggctggcaagcatggccccaggggcccccaccctggcgccaggctgctcccttcgcactatcagccctgctctatggcgctaacaacaacctggtgatctatcttcagcgttacatggaccccagcacctaccaggtgctgagtaatctcaagattggaagcacagctgtgctctactgcctctgcctccggcaccgcctctctgtgcgtcaggggttagcgctgctgctgctgatggctgcgggagcctgctatgcagcagggggccttcaagttcccgggaacacccttcccagtccccctccagcagctgctgccagccccatgcccctgcatatcactccgctaggcctgctgctcctcattctgtactgcctcatctcaggcttgtcgtcagtgtacacagagctgctcatgaagcgacagcggctgcccctggcacttcagaacctcttcctctacacttttggtgtgcttctgaatctaggtctgcatgctggcggcggctctggcccaggcctcctggaaggtttctcaggatgggcagcactcgtggtgctgagccaggcactaaatggactgctcatgtctgctgtcatgaagcatggcagcagcatcacacgcctctttgtggtgtcctgctcgctggtggtcaacgccgtgctctcagcagtcctgctacggctgcagctcacagccgccttcttcctggccacattgctcattggcctggccatgcgcctgtactatggcagccgctagtccctgacaacttccaccctgattccggaccctgtagattgggcgccaccaccagatccccctcccaggccttcctccctctcccatcagcagccctgtaacaagtgccttgtgagaaaagctggagaagtgagggcagccaggttattctctggaggttggtggatgaaggggtacccctaggagatgtgaagtgtgggtttggttaaggaaatgcttaccatcccccacccccaaccaagttcttccagactaaagaattaaggtaacatcaatacctaggcctgagaaataaccccatccttgttgggcagctccctgctttgtcctgcatgaacagagttgatgaaagtggggtgtgggcaacaagtggctttccttgcctactttagtcacccagcagagccactggagctggctagtccagcccagccatggtgcatgactcttccataagggatcctcacccttccactttcatgcaagaaggcccagttgccacagattatacaaccattacccaaaccactctgacagtctcctccagttccagcaatgcctagagacatgctccctgccctctccacagtgctgctccccacacctagcctttgttctggaaaccccagagagggctgggcttgactcatctcagggaatgtagcccctgggccctggcttaagccgacactcctgacctctctgttcaccctgagggctgtcttgaagcccgctacccactctgaggctcctaggaggtaccatgcttcccactctggggcctgcccctgcctagcagtctcccagctcccaacagcctggggaagctctgcacagagtgacctgagaccaggtacaggaaacctgtagctcaatcagtgtctctttaactgcataagcaataagatcttaataaagtcttctaggctgtagggtggttcctacaaccacagcca

SEQ ID NO: 6273 - DNA, 486 bp, Homo sapiens
agcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctgg

SEQ ID NO: 6274 - DNA, 575 bp, Homo sapiens
acagcgcgcgaagacggggtgcgcgatcctcgcaccccaggcagcccgcgacggaccggacccagctgtcacccagccgcgagggagggcagcggggccgaagggagacctgaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaact

SEQ ID NO: 6275 - DNA, 4399 bp, Homo sapiens
ataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctcttctgagggaggtaattaaaaaacagtggaatggaaaaacagtgctgtagtcatcctgtaatatgctccttgtcaacaatgtatacattcctgctaggtgccatattcattgctttaagctcaagtcgcatcttactagtgaagtattctgccaatgaagaaaacaagtatgattatcttccaactactgtgaatgtgtgctcagaactggtgaagctagttttctgtgtgcttgtgtcattctgtgttataaagaaagatcatcaaagtagaaatttgaaatatgcttcctggaaggaattctctgatttcatgaagtggtccattcctgcctttctttatttcctggataacttgattgtcttctatgtcctgtcctatcttcaaccagccatggctgttatcttctcaaattttagcattataacaacagctcttctattcaggatagtgctgaagaggcgtctaaactggatccagtgggcttccctcctgactttatttttgtctattgtggccttgactgccgggactaaaactttacagcacaacttggcaggacgtggatttcatcacgatgcctttttcagcccttccaattcctgccttcttttcagaagtgagtgtcccagaaaagacaattgtacagcaaaggaatggacttttcctgaagctaaatggaacaccacagccagagttttcagtcacatccgtcttggcatgggccatgttcttattatagtccagtgttttatttcttcaatggctaatatctataatgaaaagatactgaaggaagggaaccagctcactgaaagcatcttcatacagaacagcaaactctatttctttggcattctgtttaatgggctgactctgggccttcagaggagtaaccgtgatcagattaagaactgtggatttttttatggccacagtgcattttcagtagcccttatttttgtaactgcattccagggcctttcagtggctttcattctgaagttcctggataacatgttccatgtcttgatggcccaggttaccactgtcattatcacaacagtgtctgtcctggtctttgacttcaggccctccctggaatttttcttggaagccccatcagtccttctctctatatttatttataatgccagcaagcctcaagttccggaatacgcacctaggcaagaaaggatccgagatctaagtggcaatctttgggagcgttccagtggggatggagaagaactagaaagacttaccaaacccaagagtgatgagtcagatgaagatactttctaactggtacccacatagtttgcagctctcttgaaccttattttcacattttcagtgtttgtaatatttatcttttcactttgataaaccagaaatgtttctaaatcctaatattctttgcatatatctagctactccctaaatggttccatccaaggcttagagtacccaaaggctaagaaattctaaagaactgatacaggagtaacaatatgaagaattcattaatatctcagtacttgataaatcagaaagttatatgtgcagattattttccttggccttcaagcttccaaaaaacttgtaataatcatgttagctatagcttgtatatacacatagagatcaatttgccaaatattcacaatcatgtagttctagtttacatgccaaagtcttccctttttaacattataaaagctaggttgtctcttgaattttgaggccctagagatagtcattttgcaagtaaagagcaacgggaccctttctaaaaacgttggttgaaggacctaaatacctggccataccatagatttgggatgatgtagtctgtgctaaatattttgctgaagaagcagtttctcagacacaacatctcagaattttaatttttagaaattcatgggaaattggatttttgtaataatcttttgatgttttaaacattggttccctagtcaccatagttaccacttgtattttaagtcatttaaacaagccacggtggggcttttttctcctcagtttgaggagaaaaatcttgatgtcattactcctgaattattacattttggagaataagagggcattttattttattagttactaattcaagctgtgactattgtatatctttccaagagttgaaatgctggcttcagaatcataccagattgtcagtgaagctgatgcctaggaacttttaaagggatcctttcaaaaggatcacttagcaaacacatgttgacttttaactgatgtatgaatattaatactctaaaaatagaaagaccagtaatatataagtcactttacagtgctacttcacacttaaaagtgcatggtatttttcatggtattttgcatgcagccagttaactctcgtagatagagaagtcaggtgatagatgatattaaaaattagcaaacaaaagtgacttgctcagggtcatgcagctgggtgatgatagaagagtgggctttaactggcaggcctgtatgtttacagactaccatactgtaaatatgagctttatggtgtcattctcagaaacttacacatttctgctctcctttctcctaagtttcatgcagatgaatataaggtaatatactattatataattcatttgtgatatccacaataatatgactggcaagaattggtggaaatttgtaattaaaataattattaaacctatgtcttgtgttgccactctgtcatttagggtgggatgtagagtacttttaatcttaaaaaatagagtgagacaaaaacctacacaacttttaaaactttctctttaagtagatctttacttctaacaataacaaaggcattttcatcagttatgtgaaatacgaagattatatctattatggcgatttattttaaaggtaagggaaatgaggtacagcaggacctttctaggaaatgtggcatacaaaacatttttatctcataaaacataaaaattacaaaaatattcttacaaaggtatcacatacagaatacattaaatagcagatttcagtagtgcatggagattgattttcttatttacgattactttttttcctcaccttcctctttggaaagcattttttgcacaaagttaagtttacttatgttaacttgccacttaatgagagaggaagagaaagagtgagagcacaagatcatgtgctggaactaaaaatgttctattcaacccagcaatccctctactgggtacctacccaaaggaaaataaatcgttttatcaaaaagacacttgcagtggtatgtttatcacagcagtattcacagtaacaaaatcatggactcaacctaagtgtccatcagtggtgcctggaataagaaaatgtggtacatatacaccatggaatactttgcagccataaaaaataatgaaaccatgtgctttaaagccacatggatgcagctggaagccattatcctaactgaaataattcagaaacagaaaatcaaataccacatgttctcacttataagtgggagctaaacagtgggtacatgtggacacaggattccaaagtgagaagggtggtgtattagtccattctcatgctgctacaaagaaatacccgagactgggtaatctataaagaaaaggggtttaaatgactcgcagttctgcatggctggggaggaggcctcaggaaactcacaagcatggctgaaggcgaaacagaagcaagcaccttcttcacaaggcagcaggagagagagtgccaacaggggaaatggcagatgcttataaaaccatcagatctcatgagaacttactatcatgagaacagcatgggggaaactgcccccatgattcaattacccccacctggttccttcctcaacacctggggattatggggattacaattcaagatgagatttgggcggggacagaaagcctaatcatatcagatgggaaggacatgagggttgacaaaatatgtattgggtacaatgttcactgtttgagtgatgggtccactagaagcccaaacttcaccattatgcaatgtaccatatatacgcaatgtaacaaacctgtacatgtaccccttcaatctgaaataaaagttgttttttttttt

SEQ ID NO: 6276 - DNA, 2447 bp, Homo sapiens
gagattccggcctggagctcccagggccgaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 6277 - DNA, 2192 bp, Homo sapiens
ggggagattccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 6278 - DNA, 1966 bp, Homo sapiens
attccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactg

SEQ ID NO: 6279 - DNA, 1358 bp, Homo sapiens
atggagctgaagcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactg

SEQ ID NO: 6280 - DNA, 2505 bp, Homo sapiens
gaaaagcagaagaaaaaccaggagaatgtggtatcgtggcacccaagagaaggttttttctaggaggaggaagtgatccattgtgtaaggtcactttggtggcagttcatggagaatagcttgaggtgacaagacagcagacacgacgtgggtctctgggactgcctgtgccgttgtgggcagcccctccagagccctgagtcacgcagccttcagaggcacccatggctacgagaagcacagtctctgcctgaggctccagagcggccctttttccccagcagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 6281 - DNA, 1695 bp, Homo sapiens
gagctcccagggccgagcagaccttgggacctgtgagcgctgcatccaattaaccatgggaagggtcagcaccagccaccagccccttaggtgaggactctgcctggggctctgctgatggttccgaatcatggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 6282 - DNA, 2246 bp, Homo sapiens
ccggcctggagctcccagggccgagcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcctgggactggccagagctgggcccaagctgcgctggaatcgcagcaggagaggggagtgggctggttcttcccaccacttcccaggctctgacagccgagactcatttccaaggcacagcagctttctaaagggactgagtttggactgggttttggacctccaggggctggagcttcatcacctgggcagtgtcttttctcagagagcaggtttctttatagtttggaaataaatggttcacggtccactggccgccttgtgttgctggagacgtgggggcagggaggggacagtgtgggcctggcctctcctttcctttccctgcctggagccttcttcaaatgtctggtcttaagccaggcctccttcattttctcgctcctgttagaacaccagtcccctccccagtggggccccactgcacctgctggcaggaaataaatgaatgtttactgagtactgcattctggagaccttacatgttttcacagcctagtttgaatactggctttgtcactagctgtgtgaccctaagcaaatgacctaacctgtctgtgccgtagttttttaatctgtgaaatggggataatgtctatctcagagtccttttgaagattgagtcattattagtaacagattaaatgttatataagcatttcttttaa

SEQ ID NO: 6283 - DNA, 588 bp, Homo sapiens
atggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgcttccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcggg

SEQ ID NO: 6284 - DNA, 731 bp, Homo sapiens
gcagaccttgggacctgtgagcgctgcatccaattaaccatgggaagggtcagcaccagccaccagccccttaggtgaggactctgcctggggctctgctgatggttccgaatcatggagctgcagagagctcctccagcctggagacgttcttggtgaaagctgtggtctaactccaccggctcttcctgcacattgtattcaagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctcgcgcggcactggtcctggtggtcctcctcatcgccgggggtctcttcatgttcacctacaagtccacacagttcaacgtggagggcttcgccttggtgctgggggcctcgttcatcggtggcattcgctggaccctc

SEQ ID NO: 6285 - DNA, 1454 bp, Homo sapiens
agattccggcctggagctcccagggccgagcagaccttgggacctgtgagcgctgcatccaattaaccatgggaagggtcagcaccagccaccagccccttagaggggtgcctgcccccgctgactcaggagctccggtgctgcagccgccacgaatggggaggtgggccctcgatgtggcctttttgtggaaggcggtgttgaccctggggctggtgcttctctactactgcttctccatcggcatcaccttctacaacaagtggctgacaaagagcttccatttccccctcttcatgacgatgctgcacctggccgtgatcttcctcttctccgccctgtccagggcgctggttcagtgctccagccacagggcccgtgtggtgctgagctgggccgactacctcagaagagtggctcccacagctctggcgacggcgcttgacgtgggcttgtccaactggagcttcctgtatgtcaccgtctcgctgtacacaatgaccaaatcctcagctgtcctcttcatcttgatcttctctctgatcttcaagctggaggagctgcgcgcggcactggtcctggtggtcctcctcatcgccgggggtctcttcatgttcacctacaagtccacacagttcaacgtggagggcttcgccttggtgctgggggcctcgttcatcggtggcattcgctggaccctcacccagatgctcctgcagaaggctgaactcggcctccagaatcccatcgacaccatgttccacctgcagccactcatgttcctggggctcttccctctctttgctgtatttgaaggtctccatttgtccacatctgagaaaatcttccgtttccaggacacagggctgctcctgcgggtacttgggagcctcttccttggcgggattctcgcctttggtttgggcttctctgagttcctcctggtctccagaacctccagcctcactctctccattgccggcatttttaaggaagtctgcactttgctgttggcagctcatctgctgggcgatcagatcagcctcctgaactggctgggcttcgccctctgcctctcgggaatatccctccacgttgccctcaaagccctgcattccagaggtgatggtggccccaaggccttgaaggggctgggctccagccccgacctggagctgctgctccggagcagccagcgggaggaaggtgacaatgaggaggaggagtactttgtggcccaggggcagcagtgaccagccagggcaaatggcttagaagcaggccactccccagcctgctgccagcactcactgtgctcaagccgccagggctcatcatggtagctgggagctgtggacgggagtcaccaggtggtggggccaagccagggactcatgacttttgcccctcccttcagagcctggtcacacaaggggcgagcaccaggccagcct

SEQ ID NO: 6286 - DNA, 4080 bp, Homo sapiens
ggcggccgctcgggcaggatggcggcggccgcggtgggcgcgggccacggcgcggggggcccgggcgcagcgagcagcagtggtggggcgcgcgagggcgcgcgggtggcggcgctgtgcctgctgtggtacgcgctgagcgcgggcggcaacgtggtcaacaaggtgatcctgagcgccttcccgttcccggtgaccgtgtcgctgtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgacctacgtctaccagtggccctggacgctcctgctcctggctgtcagcggcttctgtaactttgcccagaatgttatcgccttcagcatcctcaacctcgttagccccctgagctactcggtcgccaatgccaccaaaagaatcatggtcatcacggtgtccctgatcatgctgcgcaacccagtcaccagcaccaacgtcctgggcatgatgaccgccatcctgggggtcttcctctataacaagaccaagtacgatgcaaaccagcaagccaggaagcacctcctccccgtcaccacagcagacctgagcagcaaggagcgtcaccggagcccactggagaagccccacaacggcctcctcttcccccagcacggggactatcagtacggccgcaacaacatcttaacagaccacttccaatacagccggcagagctacccaaactcgtacagtttgaaccgctatgatgtgtagagtccaaaggacaggaccagactgttggtgactccttccccggcccccacagcagtatcagaaacttctgacaatcagtgaatgtacaacccagccgaggggacggtgcataactctccatcagaagccctggggttcctggccccccgtgagccgcaggaggatgcgttgcctgcagtgcagacggccgtgagctctgggcaaacctaaacagagaccagtgtctcatgctctttcttcctggagtctgtcatctgagggccgtgtccctgcggagatcttggccacgttgtacctttccatgtggaattattccccaagcagtgtagctcagagcacttgtgtctgcattccagataacattcaggacctgtgtgaaaagctggggtcactgtggctgtagaccatgaactggcagtgggggtgtccagggcggtgcttgagaacgtcagactggctagtttaattccctggcgcagatacgcataggaccaacagggtcaccaagcagacagggagcccgcgagaatcattcaaaacatccccagccacagagatggatccagtttcctggtcatccccttagcagttcacaagttcctggcaaatgttccaaagcaaaaagcgattgcaattagcatccagttcctgcagcctggtgctctgccctgcacgtcagggttggcatccacccagatccagatggaagggaaacttctctcttctcctttgcctcctcttccctcaccagagcagggcgcttctcttggggtggtgagaaggatcttcgagaaatcgtgttcagtatttcaagctctatttctgtggcacatgtcttttgagaggcatcttcacctcttctgtgatgacttggtatgttgtttggtagagagatcttgattttcggaggatcttgcatttttctagggaatattttgtagttgtgtgtgtgtgtttttgccttggtccccattatgggatgcattaggactggcctatgcatcgaaaatctttttgtttgtaaacgtttaaaaacaaagttccccggccaggcacagtggctcacacctgtaatcccagcactttgggaggccaagatgggcggatcacgaggtcaggagttcgagaccagcctggccaacatagtgaaaccccatctctactaaaaatacagaaattagccgggcatggtgtcgcgtgcctgtagtcccagctcctcaggctgctgaggcaggcgaattgcttgaacctgggaggcagaagttgtggtgagccgagattgtgcactccagcctgggtaacagagcgagactccatctcaaaaaaaaaaacaaaacaaaaccaagttcccactggtgatgcctgtctgacacgttttggtatttagtaggaaatgaagtgtttcgaagcttcgagagaagcttcaaaattgtcacaattgctgaaaacagaatgaatcgtgaacattatctcaatattttgtataatagacaagaccacagtgttttggttccctgacctgtttttgtgtttatgttaggatctgaatcatgttctgggtaaggggacgaggagcgaacactgcactaagatttggtttgccaaatcagattctttggtcaagagtcagtttggggccaggcgtggtggctcatgcctgtaatctcagcactttgggaggctgaggtgggtggatcactggagtttgagaccaccctggccaacatggtgaaaccccatctctactaaaacaaaaattagccaggcatggtggcacctgcctgtaatcccagctacttgggaggctgaggcaggagaatcacttgagcccaggaggtggaggtttcagcgagctgagatcacaccactgcactccagccttggtgacagagtgagactctgtctcaaaaaaaaaaaaaaaaaaaaggaatcagtttgggtcttggcagaaatcaacataaggaatatgacaagaccccagtaggtaaccctgagtgctcaggtccgagctgtggtctcttttacggcttcatgaaaggaccgtgccctcacggaggggaccacggcttggcttgtggggtcttaggtgatggctgccttctttcttcatcaccacacccagcttcttgctggcacttaggggaagagagcagcaaatgagagatttaccttttatctcccagcgagcgagatgtttccctgttcagagaggaagtaacatcacttatgcttgactggtgtttcttttgttgttgtttgtttttctttcaattggaattctgtatttaagatgttatgtcagctgacacatgggacactcctgaagaggtgactggccccccaccctgtttggcggtgagtttccgcaccaccggcctcagaagtgtccctcttgcttcgtctcttgttcgcttgctttgtaaatactttggtcccaagctgagacaattgctgtgtaaaacgtgaagagtcaatcccaaagggtgttatttgtcagaagaacttgccgtgtgccttcaccgaaggcagtcaagtctgcagttggatttttctcactggtgaatgacaagaaacagggataattttgcactgcggagatattacgggagttgtctatatgattatatatagtacctgattctttgaacatattattgaactccaaaatgaattcgacctccattcaggcttcctgaaatctctgaagttgctgaaatttgtatattattttccttttccaatgcaagatctgctggtgacgggaaatgactgtctggttttattatggtttataaattaataaatgggctatttaattctgtatataaa

SEQ ID NO: 6287 - DNA, 595 bp, Homo sapiens
gtgccacatcctggctctgtgcgctgggctcccgccgctgctgcgcgcctggcgcgtgccccccgcgccgcccgtctcgggccccggacccagtccgcatccgtcgtccggcccgctgctgccgccgcgcttctacccgcgctacgtgctaccgctcgccttcggcaagtacttcgcgtccgtgtcagcgcacgtcagcatctggaaggtgcccgtgtcctatgcacacaccgtcaaggccaccatgcccatctgggtggtcctcctgtcccggatcattatgaaggagaagcagagcaccaaggtatacttgtcactcatccccatcatcagcggtgtcctgctggccaccgtcaccgagttgtcttttgacatgtggggactcgtcagcgccctcgccgccacgctgtgcttctcgcttcagaacattttctccaaaaaggtcttgcgagattcacggatccaccatctccggctgctcaacatcctgggctgccacgccgtcttctttatgatccccacctgggttctggtggacctctcggctttcctggtcagcagcgacttgggtctgccttcagagaatgtgttataa

SEQ ID NO: 6288 - DNA, 1430 bp, Homo sapiens
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcaggtcccgcaggccctgcaccgagtcgccttgtccatggcgctgccctgccccatgcttcctgcgtcctgagtaggaggtatctccgagacaggaaaagtggccgctctctctcactttttctggaactcatggtggtctcctgggcttggtcactgtctctcaccagcatgtttctttgtgcggtcaggaattatttccaaatgctcctgaagcctagtgttttagtgaacattagtgattgttagcagtggttcaaaaaaaaaaaacttttttttttttttt

SEQ ID NO: 6289 - DNA, 2078 bp, Homo sapiens
gcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgtcctcgggctccacccggggagctgtgcccagacagcagaagggaaggatgtcacttctgagatgaggttcagaaaggcctgggctcctgtcctggctgctctctcccactccctgatgagcttgctggatgaaagctcctgtcaggctgtggggcgtcctgtggagaagctggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtgcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcaggcccagtaaatgcggatgtttatcttccattgtttgtttcctgagattcagatgtctaaagcatttttctgtgacttttcaaggcaagaggaaaacctgacatatggaaagggaattaattgctcgttttatcctcttctcctgcaatgctctgaatccatgggtttggagtggggccctgggagttgggggaagcaccatacccagtgagtctgcactttgaggacccactgccagtgtcagcttcaaaatcacattgtaaaaggcccggcgcggtggctcacgcctgtaatcccagcactttaggaggacgaagcaggcggatcacttgaggtcaggagttcgagaccagcctggccaatatggcgaaacctcgtctctaccaaaaatataaaaattagccgggcgtggtggcgcgggcctgtggttccagctactcgggaggctgaggcaggaaaattccttgaacccgggaggaggctgcagtgagccaagaccacgccactgcactccaacctgggcggcagagcaaggctccgactcaaaagtaaatacatgaataaataaaataaaatcacatcgtaa

SEQ ID NO: 6290 - DNA, 1157 bp, Homo sapiens
ggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcacctcttaggccccgcccgccagcgtccctttgttgtgaaggcgccggggcctagcgctatgcctgcggcggagactgcatcaggctctcgcgtctgcttctacgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttatatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacaggacgtcccagtgatcgggaggagcgggaagagcttcagctacaaccaggacgtggtgctgctgcttctgacagacggagtcctgttccaccttcagagcgtcacggcgtacgccctcatggggaaaatctccccggtgactttcaggcccagtaa

SEQ ID NO: 6291 - DNA, 5926 bp, Homo sapiens
tccgtggctctggggcactgaggagcggcgcccgcggggcagcgaggagcccgatgcagggttctgcgcgtcatttccggtcccgcgggcgccccgtgaagcccacctggatccgccagcgctgtgccactccccagtgccgagctccgagctgtctccgcggcctcgcgcccggcccctccaccgcgcgcctctcaggccccgcccgccagcgtccctttgttgtgaaggcgccggggcctagcgctatgcctgcggcggagactgcatcaggctctcgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagagaccagaccagtagctgactgtgtccgccgagcccatccccgtgtagtgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggcgccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaaatgatcctcccacctcagcctcccatgtggctggaaccacaggcacgtgccaccatgcctggctatttttttgttgagctgggctctcgctttgttgcccaggctggtcttgaactcctcggctcaagcaatccttcctactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgtggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggtaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcggtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgg

SEQ ID NO: 6292 - DNA, 6261 bp, Homo sapiens
gcgggcgccccgtgaagcccacctggatccgccagcgctgtgccactccccagtgccgagctccgagctgtctccgcggcctcgcgcccggcccctccaccgcgcgcctctcaggccccgcccgccagcgtccctttgttgtgaaggcgccggggcctagcgctatgcctgcggcggagactgcatcaggctctcgtcctcgggctccacccggggagctgtgcccagacagcagaagggaaggatgtcacttctgagatgaggttcagaaaggtctgggctcctgtcctggctgctctctcccactccctgatgagcttgctggatgaaagctcctgtcaggctgtggggcgtcctgtggagaagctggcaagaaactggtgggggccctttccacctatagccagcaaggaactgaacccagccagcgtccacctgagtgagctcagaggtgggcctcagccccagttgagccttcggatgaggtcacagccctggtccatggtgtgactgcagcttcaggagggaccttaagccagaggtgcctggctaagcttcccgcagattgctgccccacaggagccaacatcaaaagcatttgttgttttgaggtgcgtctgcttctgcgctttgcctgggagaggccctggtggcctcgttcctggcgcccggagtccctgctgcggccccacccccgggcggtcacggtgacccatgctgcccagcctggaggtaaaatcgttcgtggctgtggcttcagcatgtcgtcctcggtgaaaaccccagcactggaagagctggttcctggctccgaagagaagccgaaaggcaggtcgcctctcagctggggctctctgtttggtcaccgaagtgagaagattgtttttgccaagagcgacggcggcacagatgagaacgtactgaccgtcaccatcacggagaccacggtcatcgagtcagacttgggtgtgtggagctcgcgggcgctgctctacctcacgctgtggttcttcttcagcttctgcacgctcttcctcaacaagtacatcctgtccctgctgggaggcgagcccagcatgctaggtgcggtgcagatgctgtccaccacggttatcgggtgtgtgaaaaccctcgttccttgctgtttgtatcagcacaaggcccggctttcctacccacccaacttccttatgacgatgctgtttgtgggtctgatgaggtttgcaactgtggttttgggtttggtcagcctgaaaaatgtggcggtttcgtttgctgagacggtgaagagctccgcccccatcttcacggtgatcatgtctcggatgattctgggggagtacacagggctgctggtcaacctctccctcatcccagtcatgggcgggctggcgctgtgcacggccactgagatcagcttcaatgtcctggggttctcggccgcactgtccaccaacatcatggactgtttgcaaaatgttttttcaaaaaagctgctcagcggggacaaatacaggttctcggccccggagctgcagttctacaccagcgccgctgcggtggccatgctcgtcccggcccgggttttctttacggacgtcccagtgatcgggaggagtgggaagagcttcagctacaaccaggacgtggtgctgctgcttctgacagacggagtcctgttccaccttcagagcgtcacggcgtacgccctcatggggaaaatctccccggtgactttcagcgtcgccagcaccgtgaaacatgccttgtccatctggctcagcgtaatcgttttcggcaacaagatcaccagcttgtcggccgttggcacagccctggtgaccgttggggtcctgctctacaacaaagccaggcaacaccagcaggaggcgctgcagagcctggctgcagccactggccgggccccagacgacacagtggagccgctgcttccacaggaccccaggcagcatccctgagagcaggaagctgccagctgctgctgtcctcgtgacactgcatcccccagaaatgggcagggacgccctcctccatggccctgctggggtgcaggacatggggagctaagttggccattgcctgcggctttctcggtttgtcggtgaagaccagcagaaactcaaactggggattccaggtatcagcttcctggagtagagaccagaccagtagctgactgtgtccgccgagcccatccccgtgtagtgtgaaaacagcctctgaggctcccatgctgggggtgcccacttcctctctgggcgacaccccagggtccaccgggagccagaggtgggtccagtgccaacgagagccgctccctgccacagccaagagagccctcggcttcccacaccagccatcgaaggccctgaggccctggaccggcggcagactggccctgggcatgaggccacagagcagggccgaagggaggggacagagggccctggaaggaagggtctcctgctgccacggtgggcactcagaacttctccccacctgacccagggctgtgggcatcctcagactatcccagaggcatcgcaagcctcaagctgcagcattgcacggcactcaagggctatgaccacggaggccgttcagtcgcttctgtttagaggaaggccccctacctcttccacaccctgccctcctatcccttccacaccctgggctgcgtgagctccccgcaaccccagggcaccctgccctcctacctgtgggggtttccagccctgaggttgaggacaaacctctcgtgtttaacttgggaggagatgtgtacgttccttttcttttttggactctgagtatgaggcaggctgttctgaggtccccgtggggtgagcctgtctgtcctccctcagagcccaccgttcctatcatcatctagcacctgtccggttccccacgtgagccttgggcaggacgctgcagtgttgatggtttgggttacgtggcgtttacctgggcgccgtccttgctgaaaaaggaaacgtccacactgaatgtttctggggcgcgtggtgtgtgtcaggcgcccaccctgtcccactctccccaagggacagtagtacggcacactggggccaccagccagctcaactcatcctcctgtgtcacgcacccccgagggcgcaggaggcctgaggagtggctactggagccgtgtgttaggcagaggcttctgaccatgtctgagctctttacccccaatctcgcagctggcggattcccatgcccggtgcagcctgttgccagccagcctttgagacccagagctccagggcttgtcagaggcagcatggggcgccagtggtcctgagtctcatttccctgcctgctctttaggcctttggcacccatggtcacttcactggctttccatttggcttctcacctgggaaatacaaaaatagcccctcctgaagataaaatcattcagaaacagagcaataattctgactcattaacttctacctactcaaaaaagtctgccatgatgatggaccgaagtgaggctttttaacccacaagtaacctttttatttttttgagacagtcttgctctgtctgtcacccaggctggagtacagtggcatgatcttggctcactgcagcctcgacttcctgggctcaaatgatcctcccacctcagcctcccatgtggctggaaccacaggcacgtgccaccatgcctggctatttttttgttgagctgggctctcgctttgttgcccaggctggtcttgaactcctcggctcaagcaatccttcctactcagcctcctgtagtgtcgagaatataggcgtgggctactacacctgcttcagccgcttctataaaaccgctgacctgtgtgtggaggacaggccaggtgtgtgctcactgcgctgcgaagatgttttgtcacgtgactttccccggatttccatttctttttttctgctttcctcaaaaactaatagaagactgggtgtggtggctcacgcctctaatcgcagcactttgggaggcagcagctggcggatcacaaggccaggagttcgagaccagcctggccaacatgatgaaaccctgtctctaccaaaaatacaaaaattagctgggtgcgatggtgggtgcctgtaatcccagatactcaggaggctgaggcaggagaattgtttgaaccccggagatggaggttgcagtgagccaagatcgtgccattgcactccagcctgggcaacagggcaagattccgtctcaaaaacaaacactattagaaaatgccctggaggtggcggggagttgttgatttgtgaggacagattgaaagcaactcccagggtggtaatgtggctgccggcctctttgaagattgtggtctggcataaggagaggtgcaggcgcctggttctgagcaccttggaatttccagccgcacagcatctggtgccctcccctccaccctcacaaggagctgccatcctgtttggattttctgtttgtggaccagaaacaaacgtttttccaaaggattagcaaatagggtaatttcctgtgtaacgctgctctggggcctcttcctcatcctggcagaaggagcctggagcccatgaggcagccagcactgtgcccttgctcagtcgtgctgtcccctccctctccctcagtctcctctccatgcccaagtcggtttccagccgctggtcttcatggcattcccagcacagccgggcaccaagaggcaaaacccaaggcctggcttggccgtgttaacgattgtacagacattttttaaaataactttgtgtaatacttttctggaatagtaagttcttgttgaactgtcacaggtgagcttctaggaacacaccgggtgtggttacttccactgggtgtgtccatggtcgtggtctgtgcttttgtaaacgaacagaacacttgaaccacctcccgaattgggtcatcggcttctttacgttgatacttagagatttgcagctctctttcaaggaaacttcccctactgaaaggcataaaaaggttaaaaaagaaaatccgagagtcccaattccctgtataacagcattaaaataatctgcctgcctggaaagatgagaacactgttgcacaacccaaaatgtgtctttaatttgtgaaaaattaccatggtgagtcagacagtcattttaaacagctgaacagagactatcatcagcaaatagagctcagctttgtagctgcctttaaaatccttgtcccaaatccggtgagctctgcttgctgccgccgcgctcctgggtgatcactcagacgggtcagtgggaataacaggccaacaagacagctttttacatgtgtccaaaggatggcctttcgaaggcctggaagtatttcactgttggaagaagtaaacaagaatgacattccagatggaaatagaattctctctcttgcctttgaccaacatggtactaaggggtttcttctttcccaatgtatgtacgtgccctgctgggggccttactttatagaatgagagcatccgagcttccctaatgaatctggctagttctgtgtctggctgaggatacaggagtgggacatccactctcggatccctcagagcacagaaaccttcagctttgctgtctctgaagtatttcctccagtttccctgcgggcccctatgtttgagtttgatggctgctggatcctcactcaacgaaaactcggttggaaactgttccgcctggcagtccttttttgttgttttccatctcatttcccttccatctgaaagtggcattcagctgacttgctcatttagactgttcacggagtctgaatctgccaacgtggtgttggaggctccaccttgaaaagggccacagtcagggcaactttccccatacaggaaaacttgaaaattacatcaacagtctacgtcacagccaaattatatttcctttataccaaacaaaactatggagaactaaaagtacatcacacaaaacgtttatagtgttttgcatgtgacctatttcagtatttatataactagattagtgctttctagcaaacggttctgttaattagcgagtcactgttgattctgctgtggtggtaagttgataccgtgtaactaatcccgtggatgcctcctcgttatttttgtccaaacgaagcagccgtggtagtagctgtctatgattcttgctcagcaaagtaaaataaatgttaaatatgga

SEQ ID NO: 6293 - DNA, 5014 bp, Homo sapiens
gcggaagcactggagccccgagtcacgtggctgcgggcggagatgagcggggcgtgggacgtgctgcggcgtcctagctggcttacagggcggcggcggggtgtgtgtcctctgttaagagtgctactcgcccggggttgatctgtgcatgccactcctgggtcagacggtgaggtcggcgtctgcgaggacgcggcggtggagtagaagggcagccggagacaggcccggcgccccttccgaggctagacggccccagcttcgcggggatcatggcattgctggtggaccgagtgcggggccactggcgaatcgccgccgggctcctgttcaacctgctggtgtccatctgcattgtgttcctcaacaaatggatttatgtgtaccacggcttccccaacatgagcctgaccctggtgcacttcgtggtcacctggctgggcttgtatatctgccagaagctggacatctttgcccccaaaagtctgccgccctccaggctcctcctcctggccctcagcttctgtggctttgtggtcttcactaacctttctctgcagaacaacaccataggcacctatcagctggccaaggccatgaccacgccggtgatcatagccatccagaccttctgctaccagaaaaccttctccaccagaatccagctcacgctgattcctataactttaggtgtaatcctaaattcttattacgatgtgaagtttaatttccttggaatggtgtttgctgctcttggtgttttagttacatccctttatcaagtgtgggtaggagccaaacagcatgaattacaagtgaactcaatgcagctgctgtactaccaggctccgatgtcatctgccatgttgctggttgctgtgcccttctttgagccagtgtttggagaaggaggaatatttggtccctggtcagtttctgctttgcttatggtgctgctatctggagtaatagctttcatggtgaacttatcaatttattggatcattgggaacacttcacctgtcacctataacatgttcggacacttcaagttctgcattactttattcggaggatatgttttatttaaggatccactgtccattaatcaggcccttggcattttatgtacattatttggcattctcgcctatacccactttaagctcagtgaacaggaaggaagtaggagtaaactggcacaacgtccttaattgggtttttgtggagaaaagaatgttgtcccaagaagataaaaaatattgttaagtgtgcaagttattaaaaaaaaaaaattgggccaggcacggtggctcacgcctgtaatcccagcactttgggaggccaaggccagcggatcacttgaggtcaggagttcgagaccagcctgaccaacatggagaaaccctgtctcaactaataatacaaaattagccaggcgtggtggcgcatgcctgtaatcccagctactcgggaggctgaggcaggagaatcacttgaacccgggaggcggcggttgcagtgagccgagatcgtaccattgcactccagcctgggcaacaagagcgaaactccatttcaaaaaaaaaaaattggtgacagactcaatgatggaatgatttgtcggaattaacacaaagcagattttattcatataatgacttttttttaagagtctcttttttaaaaaaacttaattctctaaaaccgaaatggttcatgcttctttttaaaaatgattgtataaaatgtatggaatggttagcctggtgtggtggtgcacacctgtaatcccagctacttgggagactgagacatgagaatcgcttgagcctgggaggcggaggttgcaatgagccaagatcgtaccactgcactccagcctgggcgacagagcaagacactgtctctctctctctctccatatatatatgtgtgtgtgtgtatatatatatatatgtgtgtgtgtgtgtgtgtatacatatatacacatatatacacacacacatacatatacatgtgtatatatataccatcccatatatatgtgggatatatatatatatatatatggatatggttatatatatgggatggtttggttggtcccagcaaagtatatgaaaattaaagttctgtgataatgacaaaggaattgctgttactgtactgcaaatatgctgtgggttctcggtgttcaaactcttctaaggaaggacacacagtagctctctgcttgctgatagatggtttcccagtgtgagatttgttattttgatcagagtattcaaatcagaatttaaatctagtgtttctattttagtttagcttcctgatttatataaatgaaatctcatttataaagtataataaagatgactgtaagacaaaatccaattctaaaagtatgatttttttctagtagaaaattgatgtaagaaatcatacattattcatacatttataggtcatctctttgagttttcagtgaactatagaaactatatggagttaaaaaacaaaacggcagccaatctcagtggctcacacctgtaatcccagcactttggaaggttgaggcaggcagatcacctgaggttgggagttcaagaccagtctgaccaacatggaggaatcccgtctctactaaaaatacaaaattagccaggcatggtggcacatgcctgtaatcccagctgctcgggaggctgaggcaggagaatcgcttgaacccaggaggcagaggttgtggtgagccgagatcatgccattgctctccagcctgggcaacaagagtgaaactccatctcaaaaaaaaaaaaaaaaaatagccctatgtttaaatggctcaaagaaaagactataaatggaattgaacatgtttgttagctgtttgagcattttatattggtaaattttttattttcttattttttgtcttacagtcgaccaggctggaatgcagtggcacaatcatggctcactgcagcctcagcctcctgggctcaagcaatcctcctgcctcaacctccccagtagctgggactacaggtgcacaccaacatacctggctgatttttatattttttgtagagacagagttttgccatgttgctcaggctgatctcaaactcttgagctcaagccatctgtctgcctcagcctctcgaagtgctgggattacaggcctgagccaccacacctggccagtaatttcttaatcctacctccctgcttctattgcctagcccgtacatttgaggcttccatggagctttctgtggtactgaaacacttggagtgaactgcaaacttggagtgaactacatccaacctttctaaggtggctggggaaaattcttgtacagcaagttgggacaaaatagccatatagaaacagccatataagatcccaatatagaaaaattgggatattagaggaaatacatgatttccatttatggagtgctacatgtttgcaaaatgtatttctgcttttcatcttcttgacatctgaatattaaaagcagttgttgataatttcatataataaattgagacatatcattactcttgtaataattcattttctaaatgttatttatcaactttcatggagaaaacaactcttaggagaacaaagaccagcccgggcaacatggcaaaaccctgtctgcaaaaaatacaaaaattagccgggcctagtggcacgtgcctgtagctccatctactcaggaggctgaggtgggaggattgcttgagcccagaagatgcaggttgcagtgagccgagatcatgccactgcacttcagcctgggcgacagactggactctgtctcgggaaaaaaaaaaaaaaaaaaagggaagagcgacaaaatataccttttgataagacagtaaattttatgttttgtgttttttaacacaataaaaatatatatacacacatataatatacctttggggtttttaggatttttttttcctggactctgaaatgagaagcctcgctgaaaatctgttttggagaattccagtttgtcagtcagtctcttgtgtaattagtacgtgtggcttccttctttgttttaaatattctttggttcttctcattttacaaagatatatattttttgtgctaaggacagagcaattagtttttaccagataagcctcgggtattatgtttgtctaagaaacattctctgtgtatgtttaaattgtaattatttcccaaaagctgaggaaaatgtttcagcacagtgaggatttgacgtctgcactgagaacagctgagtttatttgtgccatttagaaattcgtaactgtaggctgggcgcagtggcttacgcctataatcccagcactttgagaggccaaggcgggtggatcacctgaggtcaggagtttgagaccagcctggccaacatggcgaaacactgtctctactaaaaatacaaaaattagctgggcatggtggcgggcgcctgtaattccagctactcgggaggctgagacaggagaatcacttgaaccagggagtcggaggttgcagtgagccgagactgcgccattgcacaccagcctgggtgacgagagtgaaactctgtctcaaaaaaagaaaaaaaaaaagaaatttttaaccgtaaatagaacttggggagggtgttatataatatatgtgtcagtaggaaggcagtaagaagattggagtaagacaggatggggttacatgtatataaatgaataaaataagtactgctaaaacttgagtctgataaacttttttgccccgaagataatcatcccactgaaaagaaaactctggggaaaatatgccagatactaggaccaagcacggagacaaaccagatacagtgctttcaaagaaaacatgcttgctgtcctttgttaccagtgtaattgtaattattgtttattctgtgttaagtgactgaatttcaatttttaccttttaaaaataaagagaacctctttttacttctgtattgca

SEQ ID NO: 6294 - DNA, 1350 bp, Homo sapiens
ggagtcacagccgcagccagagccgcagccaaagcctcagagagcaggagttggagcgcaggccctgctggatccgcgcctagctcgccgccaggcaccggccggaggacgggccgtggtgtcagctcactgcccgggcgctgtgggaggcagcgagcccgcgaccccccgggccgggcaccgccaggcgcggagcccagatcgcccccctgccaggcctggtcacggccagagcacgcaggagttcccagggtctggatctgcgcgcaccctaatgacctggggactgaagagaaaaaaggaacgaggatttcatctaaaagcataacgtgggcactaggcgaggaggaaagtggagaccacctggcacggggcagaggtgcctggagcccacgcttgagcatcggagaccctggcatcctagcagccgcgaccttggctctgccctgtctgagctggaaacacagcttagcttctagacatcgctggcacaggcctggcacaagtaagcagtgtcctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagcctcagcttccagatctgcaaaatggaactgatgatccctatggagagggttcgaatgaggagcgctgggcagggccaggagtga

SEQ ID NO: 6295 - DNA, 2714 bp, Homo sapiens
gggcttggctggggtgctcagcccaattttccgtgtagggagcgggcggcggcgggggaggcagaggcggaggcggagtcaagagcgcaccgccgcgcccgccgtgccgggcctgagctggagccgggcgtgagtcgcagcaggagccgcagccggagtcacagccgcagccagagccgcagccaaagcctcagagagcaggagttggagcgcaggccctgctggatccgcgcctagctcgccgccaggcaccggccggaggacgggccgtggtgtcagctcactgcccgggcgctgtgggaggcagcgagcccgcgaccccccgggccgggcaccgccaggcgcggagcccagatcgcccccctgccaggcctggtcacggccagagcacgcaggagttcccagggtctggatctgcgcgcaccctaatgacctggggactgaagagaaaaaaggaacgaggatttcatctaaaagcataacgtgggcactaggcgaggaggaaagtggagaccacctggcacggggcagaggtgcctggagcccacgcttgagcatcggagaccctggcatcctagcagccgcgaccttggctctgccctgtctgagctggaaacacagcttagcttctagacatcgctggcacaggcctggcacaagtaagcagtgtcctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagtgccctgctgcaggaggagaggctggacgcggtgaccctgctttacgccacctcgctgcccagcttctgcctgctggcgggtgcagccctggtgctggaggctggcgttgccccaccgcccactgctggcgactctcgcctctgggcctgcatcctgctcagctgcctcctgtctgttctctataacctggccagcttctccctgctggccctcacctctgccctcaccgtccacgtcctgggcaacctcaccgtggtgggcaacctcatcctgtcccggctgttgtttggcagccgcctcagtgccctcagctacgtgggcatcgcactcactctttcaggaatgttcctttaccacaactgcgagttcgtggcctcctgggctgcccgtcgggggctgtggcggagggaccagcccagcaagggtctttgagacctgggggatctcaggagccacctgggatggccctggcctgaatccagcctccgctgtggccatagaaggaatggagaacagggctgggcatggtggctcacgcctataatcccagcacttccagagtccgaggtgggtggatcacctgaggccaggagttcgagaccagcctggctaacatggcaaaacctcatctctactaaaaatagaaaaattagctgggcatggtggcgcgtgcctatagtcccagctacatgggaggctaaggtgggaggatcacttgagccctggagatcgaggctgcagtaagccaagatcgcatgctactgcactccagcctgggagacagagcgagacgctgtctcaattaaaaaaaaaaaaaagtggagaactggcagtgacctctactgggggccatggcagggaggggagccttctggaagggctgccttggagattggaatggggactcccagggagacctgcgttccatccctgcctgcctcacccctgccacagactctgcacaccactggatggtgggtccaagcctggcacagtccctgtgcttgtcagagtcattattatgattaatatcaattacgatgccaaaaattgctgggcaaactttgaagacctcaacttgttacaatgacgatgatgatgattcttggcggttacacaatccttcctcctgggggggaggcagctaggaggcccagcaggggggcttctatgctgctgggctcccctagggagttggggtagtctgtgccaactccaggcagctgctgtggcctcacccctgggccccccaattttgggtcatccatcctcaaatacactatttttgcttgta

SEQ ID NO: 6296 - DNA, 2081 bp, Homo sapiens
ctcacctgtctgaaacgggacacggggtcggaggaaccaggatctagcctggccccaagcggaactctctggtggcccagaggtcgtcactggggagcccgcctcctgccctagcctcactggtgcggatgtgccgctgcccgccggagcaccatgatggcaggatgacctcagccgaagtaggagcagcagctggtggtgctcaggcggctgggccccccgagtggccccctggcagccctcaggccctccggcagcctggccgggcccgagtggccatggcagcactggtgtggctgctggcgggagccagcatgtcaagcctcaacaagtggatcttcacagtgcacggctttgggcggcccctgctgctgtcggccctgcacatgctggtggcagccctggcatgccaccggggggcacggcgccccatgccaggcggcactcgctgccgagtcctactgctcagtctcacctttggcacgtccatggcctgcggcaacgtgggcctaagggctgtgcccctggacctggcacaactggttactaccaccacacctctgttcaccctggccctgtcggcgctgctgctgggccgccgccaccacccacttcagttggccgccatgggtccgctctgcctgggggccgcctgcagcctggctggagagttccggacaccccctaccggctgtggcttcctgctcgcagccacctgcctccgcggactcaagtcggttcagcaaagcctcagcttccagatctgcaaaatggaactgatgatccctatggagagggttcgaatgaggagcgctgggcagggccaggagtgaggaaggagggtaactttttggaagagtactttgtaacaataaagtgctgtgcacagaaaggagaaatgccattatggggatgtgtgtgccgacctgggaccagcagggtgaaagagtctatcattcatgatgagagctgccatttgcgctaagcacacaccatgtgccaggcactatgccaagaaattgttgaatcttcacaataactctgtgagaaaagggctgtcattggacagatgaggacactgatgctcccaggggtccacatcacatgaagaggaggtgacagggctgggccttggtccgaagctccagccttccaagccaaggcctgtgagaggaaccgctgagacctgatgttaggcctgtttttctcatgtgccctggagaaggggactaacaccatcttttgccaaagtttggtgagggatggccaagagctctttgaaactttgccatgtacaatagcactcacaattttttttaaattttttatacagtggtatcggggtacagtggctcatcaacactttgggaggctgaggcgtgaggattgcttgaggccaggagtttgagaccagtctgggcgacatagtaaaatctcatctctataaaaaaagaaaaaaaatgaggcgggcatggtggcaaacatctgtagtcccagccacgcaggaggctaaggtaagaggatcacttgagcctgagaggttgtggctacagtgagccatgatcacactactgcactctaggatgggtgacagagcaggacagtttcaaaaaaagacaaaaaaaaatttacacagtggaatgctttctttaaaaactatcttatgcataagtacaatctagaaaaccagaactgggccacttatagtgaaggtggaagcagaggtggcctgggaccccccaggattcctggagcactgcctgaaggccatttatctagtagattggcactcactgtaagaagcgcaagaggtaccatgatgcttaaggctctggctctgggtgtgaaagaatgaggtggaattgtagcagattcattcctgggtcaatctgtttttggggagggctgcaggattccaggcctgccatgtgcaatgggtgctgccctctttcttctgggcaccatctgcctcaacctatcccctggccagtgtcactcacagggcagaaaatttatcttcaccatctcacaattagtttaatcttaaaaaaaatggattataaagttaaaagctacagcaa

SEQ ID NO: 6297 - DNA, 4852 bp, Homo sapiens
gggactggagaggagtgagtggcgggctgggcggcggcggccgtagccgcgggtgcctccccgcctcaccgcttcgcaggcagcaccgcctcccgggccgcggccgcccggccgggtcctctgcgcgttcccgggcccggaaccggcacacgatgcacccggctgcgttctgatcgccgccgcgcctcagcctctgccgcgatgatcccccctgagcagccgcagcagcagctgcagccgccgtcgccagccccgccgaaccatgtggtgaccaccatcgagaacctgccggccgagggcagcggcggcggcgggagcctgtccgcctcctcccgggctggcgtgcgccagaggatccgcaaagtgctgaacagggagatgttaatctctgtggccctaggccaggtgttatccctccttatttgtggaattggcttgactagcaagtatctgtcagaagatttccacgccaacacaccagtcttccagagtttcctcaattacattcttctcttcttggtctataccaccacactagccgtcagacaaggagaagaaaacctcctggcaattttacgacgaagatggtggaagtacatgattttgggactcatagacctggaagcaaattatctggtggtcaaggcttaccaatacacaactctgaccagtatccagctcctggactgttttgtgatcccagtcgtgattttgctctcctggttcttcctgctgatccggtacaaggctgtgcatttcatcggcatcgttgtctgcatcctgggaatgggctgcatggtgggagcagatgtgcttgtgggaagacatcagggagcaggggaaaataagctggtaggggaccttctggtcttaggaggagccacactctatggtatttctaacgtctgggaagaatacatcatccgaactctgagccgagtggaattcctgggaatgattggtctctttggagcatttttcagtggaattcaattagctataatggagcataaggaactgttgaaggtgccctgggactggcaaataggactgctctacgttggctttagtgcctgcatgtttggtctctacagctttatgccagtcgtcataaagaaaaccagtgccacttcagtcaacctctccttgctcacagcagacttgtacagcctgttctgtggattgtttctcttccactacaagttttcaggactttatctcctgtctttcttcaccatcctcattgggctggtgctctactcctccacctccacctacatagcccaggacccccgagtgtataagcagttccgcaatccttcaggacctgttgtggacttaccgaccacagctcaggtggaaccctcagtcacctacaccagcctgggccaggagaccgaagaggagcctcatgttcgtgtggcctagggtgaggcccgccctgccaactgaggccaactcattggccatgtttttgcccatcatctctgtattgtacatagagaaaggtatttactaggtgcagtttacacaggtggactgcaaggtagcaaatcctccaaaagcttgtgaaaggaacaagctcaacatcactggagacacaggctctaatccacctgacttggaaggatgcctagctaacgtgtatcctgatcacaactcccctgcattcattactgtgaaaatttttgaatcaaaagcaagtattattgttattatgatttgtattattattattgctgttactgttattacaccaactttcaggaggatgttttgtactcctgatggaaactattgccagacccacatgtagtcaacataaaccccacttttctatggcaattcactttttaagagtcatactttatttttttgcacagactatatgagtgatgcatgccacaggagctccacccctgagaagtttccttttcctagggacctggtggttaatggtttcctctgttacctgttggattgcctgctcaataagtattttgtgctgtgacctttgtggggaggggcaactgaccatatacttctctattctaggaatagatataaaagaaacattttagcctttttatatttcgatctctgattactccaggccattgcctttctgttgtgccacgtgattctgctaatcaagtccctgtaataacaggataaggactgttccattactgtggcttttgggagcccccagaaataatatcatttgtgtttaggacaatatataattataaaatctttctgctcctccctgtagcctctcttcaaaaactatcttttattttttttccagatttccttagtgataatatggaaattaatcaaggcactggaaaaagccatggtcctctgcccttttaattctgtgacacctttttaaaaatacaccagcatggaaattacctttattgtggaaaatcattggttgtgccacctcctaacaaagtcaaggtgctgatgtggagcagtctttgaaaatggcttaattgatttggccactttgcagtggtaacaatgtcatcattgaaaaagtctggcattttggtcatatttggcatccattcaataacagatatattgacacgacattcttttttttttttttttttttttttgagacggagtctcactctgtcgcccaggctggagtgcggtggcacgatctcagctcactgcaacctccgcctccgggattcacaccattctcctgcctcagcctcccgagtagctgggactacaggcacctgccacgacgcccagctaattttttgtatttttagtagagatggggtttcaccgtgttagccaggatggtctcgatctcctgacctcgtgatccgcccaccttggcctcccgaagtgctgggattacaggcgtgagccactgcgcccggccgacacgacattcttatggacccagagaatactgcaggatcctgataagaccttgagtgatatgtcactagtctaatctgttgcccttaaaatagcccttttttcaaacacaggaaattaagaaacaccacagacctctattatttagaatagattctatgtgtcagtatgtgatgtactcttttagtttgactgacttcaataccattcaaaaagatcctcaatggagttacagggtttataggggaaaaatacatgtttatgagacattgggcaattcaaatcaacatgtgttacataagcaagcaaagcaaaacaccagtggggtctctggaaagtaaaaggacagactacagtagaaggactgatcccagagtgcctgtacaaggcctaaatctggcaggcaaaagcatcccacactgtctgtcagcacccacatggcctttttgcctgccttctataacgggtaagtggacctacccttggagatagagaagaaaaattatcttctctgatattcggatgtaatggtcatctcagttcagccccctaggaaacatgttttattttccatggggaaaatatcagcgttaaagctctatcaaatcaaaacaactttgccaacatcttctctctgctaccttttaaaccaattaaatacctttctctgaatattttgtccattcagatccgaagacctttaaagactgtggttttatttttgtgtttacattcctttggtttgaataatttgcttgatttattgcatttttagtatttattttaagccagatgttttcatctttgattcatttttatgacattaatttgtagacacttagtaaagtcttatgagaagcaagtggatgaaattatctccaagtccactcagtagactggagttttttaaaaatataaatttccaaaaagtttgcaatcaacagatggctaaaggttgccatctgaattattttataggatattttaattgactccattgtatggaaaccaagtgtgaatgttaagatgaatttgccgtataccctttatcattcggtgtccttgtactcagactttcatgtccctgggtgacctcaatgtgttggtttgtctccatttagaaaggttgataatatattgaattgttcaagatcaggagttccagactgaccctccaggaaaaaaaaaatcgcaaagaacaaattctttttctgtgtaaaaaacactgatcctttgggaatggggcgggaaatgggagtaggacaacattaactttagctgttttagtttctgagatttcataacctcagtagacaccagcaaaattttcagtttctaactccaccaccaatctctcctcaatgaataagactttagcaatttatatagaatttgatcaggtaagagcgaaccacaattctcctgaaccctgctagagattaagtggtggttctcacttcctcaatgaaaacttgcactggggacagcgcttgccttggtcagaccttcccacatctacatactctcaaatacatgaccaggtgatcaagcaatggaaaaatttgcaccaccgtgtcccatgaaattgtttcaatgtttagtttagatattgctaacttgtgctattaaccttttgacaagcgtgtagtattgtttgttttgggtttctttttgatttataactatttagtagtccccagctagctaccagtacagattttaccccatgggtaggattctattgttaagccacataacaaagcacactaattctgacaacactgcaaatggaaaatacgaaccaaaaaaaagttacaccgataagttcaacaaactgtccatttttgatatttgcatgctcccctatggactggctgtggcaatgtaatgcctgtataatgttttcaaataaaaataaatgctttatgaaagcaccgaa

SEQ ID NO: 6298 - DNA, 993 bp, Homo sapiens
gggcgccggagacgcgcaagggcgccgatggaggcagactcgccagcgggccccggcgccccagagcccctcgcggagggagcggcggccgagttctccagcctgctgcgcaggataaaaggcaaactcttcacctggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgca

SEQ ID NO: 6299 - DNA, 1076 bp, Homo sapiens
agcagggaggcagaggtggcggccgcacggacttcggttcggggctcaacacgcacaccaggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtag

SEQ ID NO: 6300 - DNA, 1714 bp, Homo sapiens
aaatcactctccctcaacgctcactgggcgccggcaggaaagtgggcgtggcgggaagacgtgacagcagcaacaaccaaggaaaatgaagcaaggtctcaactccgggagggtcagccaatgaaaactcactgataaccttgttgagccggtcgtaatcctcctcgatgcccacgctgtccaagatcttcttgatgtccttggcgctgggggaggagttacccccgagggcagccagcagcccgtggaagcctcggaaggcgtggccagggcagggcatccaagccgagcgccgggggttggcaccgtctctctccctggcacggcggagacaactgaatactgaaagacaaaaccaacacaccgcgaggaatgagccacgcctccatccacgccacaaagggcttgacagttaatgattggtcgctgaaggagccgagcggaggagcgagagggacgcgagcaagcgagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtag

SEQ ID NO: 6301 - DNA, 3331 bp, Homo sapiens
aaatcactctccctcaacgctcactgggcgccggcaggaaagtgggcgtggcgggaagacgtgacagcagcaacaaccaaggaaaatgaagcaaggtctcaactccgggagggtcagccaatgaaaactcactgataaccttgttgagccggtcgtaatcctcctcgatgcccacgctgtccaagatcttcttgatgtccttggcgctgggggaggagttacccccgagggcagccagcagcccgtggaagcctcggaaggcgtggccagggcagggcatccaagccgagcgccgggggttggcaccgtctctctccctggcacggcggagacaactgaatactgaaagacaaaaccaacacaccgcgaggaatgagccacgcctccatccacgccacaaagggcttgacagttaatgattggtcgctgaaggagccgagcggaggagcgagagggacgcgagcaagcgagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggccttggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaataca

SEQ ID NO: 6302 - DNA, 3170 bp, Homo sapiens
actgcttctaactcactgctcactcaccgcttcttagcttaggaatcacctacaataacctcgtgtcactgtatcttgtgatttcaaacaaggaaccctaaaaacctgaaggcacactgggtgccgctcaacaataaggctcggctgccaagacgaaaaaaaaattgccctttctcctcctgccaccctggaggtgccaggttgtaatctgcaaatgtattgtctggcccttagggcttgacagttaatgattggtcgctgaaggagccgagcggaggagcgagagggacgcgagcaagcgagcgagggagggagcgcagggccagagcggagccccagccggccgcacaggcaccgcctcccgtcttccgggacccggcacttcgggggttttgggcgccggagacgcgcaagggcgccgatggaggcagactcgccagcgggccccggcgccccagagcccctcgcggagggagcggcggccgagttctccagcctgctgcgcaggataaaaggcaaactcttcacctggaatattttgaaaacaattgccctgggtcagatgttgtccttgtgtatatgtgggacagccatcaccagccagtatttggcagaaagatacaaagtgaacacccccatgcttcagagctttatcaattattgcttgctgttcctaatttatacagtgatgctggcatttcgatcaggcagtgataaccttttagtaatcttgaaaagaaaatggtggaagtacatcctgctgggactagcagatgtggaagctaattatgtgatcgtcagagcctaccagtacacaactctaaccagtgtccagcttttggattgctttgggattcctgtgttgatggctctgtcatggtttattcttcatgcaagatacagagtgatccacttcatcgccgtggctgtctgtctgttgggtgtaggaaccatggttggtgcagacatactagcagggagggaagacaattcagggagtgatgtattgattggtgacatcttggtccttcttggggcttccctctatgccatttcaaatgtttgtgaggaatacatcgtgaagaagctgagcagacaggagtttttaggaatggtgggcctgtttggaacaattatcagtggtatacagctattgattgtggaatataaggatattgccagcattcattgggactggaaaattgccctgctgttcgtggcatttgccctgtgtatgttttgcctgtacagcttcatgccattggtgattaaagtcactagtgccacttccgtcaacctgggcatcctgacagcggacctctacagcctttttgttggactctttctgtttggctataagttttcaggactctacatcctgtccttcactgtcatcatggtggggtttatcctgtactgctccacccctactcgcacggccgagccggctgaaagcagcgtgcctccagtcaccagcattgggattgacaacctggggctgaagctggaggagaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttgaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttttttgctgaggcagttattgtccacaggcctttgggtacagatgaggccttggggctgactgcatgtggcagaaaacgggtgggtcagcccttgaaaagtcttgagatataagtgtgagtactatacaagcattaaactggagtgcagtaaacctaggaaccttcccacaattgtttttttgtttgtttgagatgcagagtctagagtgcagtggtgcaagctcagcttactgtaacctctgcctcctggattcaagtgttagtagctgggattacaaaagcatgtggccccacgcccagctaagttttgtatttttagtagacatggggtttcaccatgttgcccaggctggtcttgacctcccgacctcaagtgatctgcctgccccgacctcccaaagtgctgggattacaggcttgagccaccgtgccaggcctgttttgtttgtttttgtagagagatggggtttcgccatgttgcccaggctaatctcaaattcctgagctaaagcgatctgcccacctcggcctccgaaagtgctaggattacagatgtgaaccactgtgcctggcctgtttgtttgtttgtttaaaacatttctccatcactcattccaggtcccagagcaaactctctctgctctcggagcctgtgacactggctatgtgctccacagtttcagtcccaggtcatactctccaacagttttcagagctccatatatatgtagatgccatcctttctaaaaacttctcacgacctcctggaatattcctattgatctcattttatttagcatcagctcaagaaactaagtcttagtgcacagtatcacaacaaagaaaaagctttgtttttataactggtaaaaacaagaaaagattctcatcaaaatgaaaatataaaattaatcatttctcaccaaagagtatgcctgggagcctccagctgttaaaagacaatgctattactacttcttatcaaaaatctgtaatgccctgtgatttttatgatacttcttcaatacaaagtgttaatatgtgtcatcagtataataacaaccaacaaaatgccactttcagaaaactgtatgtaaattttttgtaacaatgtaaaaaagaaatggggagtaagtgttcacatcattaaaaggctttgaattcatggaaataca

SEQ ID NO: 6303 - DNA, 2762 bp, Homo sapiens
ggctgcgcggccggggaggatgtgcgctgcagggcggccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggggaggagcgcccccgggactccccgggcccggcggaggcccaggcaccggccggggtggaggccggcgggagagcgagtcgccgctgctggacgtgctcccgggcgcaactcaagaagatcttctggggcgtggcggtcgtgctgtgcgtgtgctcctcgtgggcgggctccacgcagctcgccaagctgaccttcaggaagttcgacgcgcccttcaccctcacgtggtttgccaccaactggaactttttattcttcccgttgtactacgtggggcacgtctgcaagtccacagagaagcagtctgtgaagcagcgatacagggaatgctgtcgattttttggagacaatggcttgactttgaaggtgttttttaccaaggcagcaccctttggtgttctttggacactcacaaactacctgtacttacatgcaataaagaaaataaacactacggatgtctccgtgttgttctgctgcaacaaagcttttgtgttcttgctctcatggatcgttctcagggacagattcatgggagtgaggattgtggccgccatcctcgccatcgctggcattgtgatgatgacctacgctgatggcttccacagccactccgtcatcggcatcgcactggtggtggcctcagcatcgatgtctgccctctacaaggttttgttcaagctcctcctgggcagtgctaagtttggagaagccgccttatttttgtccatcttgggtgtgtttaacatcctcttcatcacctgcattcctattatcctctactttaccaaagtggaatactggagctcttttgatgacattccatggggaaacctttgtggattttcagttcttttattgacattcaatattgtattaaattttggaattgccgttacatatcccactctgatgtctcttggaatcgtcctcagcatacctgtgaatgcagtgattgatcactacaccagtcagatcgtcttcaatggggtccgggtcatcgccatcatcatcatcggcctgggttttctcctcctgctcctgccagaggagtgggatgtctggttgatcaagctgctcacccgactcaaagtgaggaagaaggaggagcctgcagagggcgctgccgacctgagctcaggacctcagagcaagaacagaagagcccgcccttccttcgcccgctaacaccactcctctagaactcggtggtaatgactgggaggtctattcctgccgggaggaacctcagttgggtaaggtgtacatacctgtacagttttggtcatctgcggtaagttctatggtatttattggcatgtccaatttgcttgcacttttccacatcagaccttccacttaagggtaccaattcaatacaaaagagaaaagaagaacctctcagtgcttttccaacgaatgtaaagtgggtttaaaagttccctgcgtagatcgttttggatggctgacgttcttgacaagccagccatcagggcaagtgttttgaatcttagcaagtgttttgaatcttagcaactgaacatgacattgcacactgtgattatttttcagctatggtaggtcatattttgttttataccagagctgtactcttaattttaaggaatttcaatgaaccaaaagataactgtcaatttatttggatggatggatggagggatggaaggagggagggaaggatgtctgggatgtgaagaggcaaggcagaaatggatgatgaacatcaaaaactgtcagaggacaggtctgtgccaggtaccaggaaggacaagataagtccaagccccggctggcctgctctcacgtgtctgtgtaagatcatgcaagagaaatcacagtgccttctacagaattttcgtctttacctatgtgaagcgaggtgacgtgatacgtcactggcgccgtcttataatttagatgtaaaaatctttagaaacaaataaaactctctatatatgtgtatgtctgtgtacaaaaaaatgacagagctgatggccagtgtatacagagcgtggcccgcggtgtacaatacccatataaggtacattgtgcaggaggggaattgctggctgcttttacttcctgaccaagactgaaaaattatttactgaaatctgtaaacctttttatgaaacttttaagcaccaggctgtttacttacacaatttaggtctgccagaaaattctatctgtgatagatctgtaaagagggtcaggggttagagtttactatttttgaagtttacattgttacatatgaaatggaaacattattttgaaacgttgtcataacccaatggtgcattctgtaaccatggagtcttctgtttcctgggggaaaggggcattcatgacctgaactttttagcaaattattattctcagtttccattacctgtttggccaaacagattaataaaatatttgaaaaagaa

SEQ ID NO: 6304 - DNA, 2891 bp, Homo sapiens
aaagcggcccggggcggccggcgcggcgcagaccctcggtgggcagcgcactccagtcttcccaggctagcggctgcagggagctccggcccgcggcccctccgcctcaagtctgggagctgccggtcccactctgtctttgcctatggggattcgagagtttcccagcggcgcacccaggggcaagagcattgccgttggcatgaggaggtcaccggacgtcagcccccggagactgtccgacatcagcccccagctccggcagctcaagtacttggtggtggacgaggcgattaaggaggatctgaaatggtcgcgctccgtggaggatctcaccagcgggccggtggggctcacgtccatcgaggagcggatcctgcgcatcactggctactatggctaccagccctgggcagcgagctgcaaaagggaggagcgcccccgggactccccgggcccggcggaggcccaggcaccggccggggtggaggccggcgggagagcgagtcgccgctgctggacgtgctcccgggcgcaactcaagaagatcttctggggcgtggcggtcgtgctgtgcgtgtgctcctcgtgggcgggctccacgcagctcgccaagctgaccttcaggaagttcgacgcgcccttcaccctcacgtggtttgccaccaactggaactttttattcttcccgttgtactacgtggggcacgtctgcaagtccacagagaagcagtctgtgaagcagcgatacagggaatgctgtcgattttttggagacaatggcttgactttgaaggtgttttttaccaaggcagcaccctttggtgttctttggacactcacaaactacctgtacttacatgcaataaagaaaataaacactacggatgtctccgtgttgttctgctgcaacaaagcttttgtgttcttgctctcatggatcgttctcagggacagattcatgggagtgaggattgtggccgccatcctcgccatcgctggcattgtgatgatgacctacgctgatggcttccacagccactccgtcatcggcatcgcactggtggtggcctcagcatcgatgtctgccctctacaaggttttgttcaagctcctcctgggcagtgctaagtttggagaagccgccttatttttgtccatcttgggtgtgtttaacatcctcttcatcacctgcattcctattatcctctactttaccaaagtggaatactggagctcttttgatgacattccatggggaaacctttgtggattttcagttcttttattgacattcaatattgtattaaattttggaattgccgttacatatcccactctgatgtctcttggaatcgtcctcagcatacctgtgaatgcagtgattgatcactacaccagtcagatcgtcttcaatggggtccgggtcatcgccatcatcatcatcggcctgggttttctcctcctgctcctgccagaggagtgggatgtctggttgatcaagctgctcacccgactcaaagtgaggaagaaggaggagcctgcagagggcgctgccgacctgagctcaggacctcagagcaagaacagaagagcccgcccttccttcgcccgctaacaccactcctctagaactcggtggtaatgactgggaggtctattcctgccgggaggaacctcagttgggtaaggtgtacatacctgtacagttttggtcatctgcggtaagttctatggtatttattggcatgtccaatttgcttgcacttttccacatcagaccttccacttaagggtaccaattcaatacaaaagagaaaagaagaacctctcagtgcttttccaacgaatgtaaagtgggtttaaaagttccctgcgtagatcgttttggatggctgacgttcttgacaagccagccatcagggcaagtgttttgaatcttagcaagtgttttgaatcttagcaactgaacatgacattgcacactgtgattatttttcagctatggtaggtcatattttgttttataccagagctgtactcttaattttaaggaatttcaatgaaccaaaagataactgtcaatttatttggatggatggatggagggatggaaggagggagggaaggatgtctgggatgtgaagaggcaaggcagaaatggatgatgaacatcaaaaactgtcagaggacaggtctgtgccaggtaccaggaaggacaagataagtccaagccccggctggcctgctctcacgtgtctgtgtaagatcatgcaagagaaatcacagtgccttctacagaattttcgtctttacctatgtgaagcgaggtgacgtgatacgtcactggcgccgtcttataatttagatgtaaaaatctttagaaacaaataaaactctctatatatgtgtatgtctgtgtacaaaaaaatgacagagctgatggccagtgtatacagagcgtggcccgcggtgtacaatacccatataaggtacattgtgcaggaggggaattgctggctgcttttacttcctgaccaagactgaaaaattatttactgaaatctgtaaacctttttatgaaacttttaagcaccaggctgtttacttacacaatttaggtctgccagaaaattctatctgtgatagatctgtaaagagggtcaggggttagagtttactatttttgaagtttacattgttacatatgaaatggaaacattattttgaaacgttgtcataacccaatggtgcattctgtaaccatggagtcttctgtttcctgggggaaaggggcattcatgacctgaactttttagcaaattattattctcagtttccattacctgtttggccaaacagattaataaaatatttgaaaaagaagcgtt

SEQ ID NO: 6305 - DNA, 1779 bp, Homo sapiens
atggatgaactactcttggatctcttccacaaactgaccagtgggaggcagctggcagcaggcaatgggctttgcggtatatcacataaggaacaggaggtatggaagccaggacataatattttagtgaaaatgagaaaggaagataaatcactggtgtggcttatacattcaacacttgctcgctacacacaagttaccaactttttaggtacctccagatcatcagtcactagatgtaaaccaggagccaactgccccagttcacacagtggcatcagtagacaactgtccccactgtctgtcaccgaagattcctctgctcctattcttgaacttcaaaaccaaggatcctcaggagtttgtggacacagagttgagagacagaacagatcagcagacgatgggacacagactcattctgagaacagcagccaagaaaacagaatcaaggctcgctgcctgtcctgcacgtccatggttctgaagggcatctggggactcttgatcatcttgtcagtatcatcatcttgggttggaactacacagattgtaaaaattacttataagaacttctattgcccatttttcatgacttggttttcaacaaactggaacattatgtttttcccagtctattattctggtcatctagccactgctcaagaaaagcaatctccaatgaaaaaattcagggaatgcagtcggatttttggtgaagatggtctgacgctgaaactctttcttaaaagaactgctcccttttctattctatggactttgactaattacctttatttactggctttaaagaagctgacggccacggatgtctccgctctgttctgttgtaacaaagcctttgtcttcttgctgtcatggattgtgctgaaagacaggttcatgggagtgaggatagttgctgcaataatggcaattaccggcattgtcatgatggcatatgcagataatttccacgctgattccatcataggagtggcatttgcggtgggctcagcctctacatctgcattatataaggtcttgtttaaaatgtttcttggaagtgccaactttggggaagctgcacactttgtctccaccttgggtttcttcaatttgatcttcatctccttcaccccagtcatcttgtatttcaccaaggtggagcactggtcctcttttgctgctctgccatggggctgtctctgtgggatggcagggctgtggctggccttcaacatcctggtgaatgttggggtggtgctgacatacccaatcctaatctccattgggacagtgctcagcgttcctggaaatgcagctgtggatctcctaaagcaggaggtgatattcaatgttgtccgcctggctgctaccatcatcatctgcattgggtttctgctgatgctgttgcctgaggaatgggatgaaatcaccctgaggttcatcaacagcctgaaggaaaagaagagtgaggagcatgtggatgatgtgactgatcccagcatacacctgcggggcagaggcagagccaatgggacagtgtctataccactggcttagagagggacatattttgaatgcacgtgtatgtatattctgtgaatataacaaaattttctcactacctgtacactcaaacgacagtattaactctgaatttggataaatcatatgtgaaataatgccaacaataaaagtttacatttatatgcttatcaaggaattggtgtaaataatcataatggatttttttattaaaacacatttgtcctt

SEQ ID NO: 6306 - DNA, 4412 bp, Homo sapiens
cgctcggcgaccagagcctcgcattacttcccctagctccgccaagcctcgctgcatacgcgaccgcgcgcagtccgccgtcgcgcccctatgacgtcacccgcgcgccaccgcttccgggctggggactgggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctggcaagtttttgtagaaaaaatgtttcagtgcctagtctgaaaaataacagtttgagttctttgaaactctaaaatatatttttctcatacctgttttcttcattttcataatgaagcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtctatttgtgtattgtagatgtatcaagtgatttctaatttttttcacatatgaatgtgccagattactctagaactagatgtctcttctttaaataattttagttttcctgaataaatttgtaatggttaaagtaccaagtaagtaaggcgagaagggattctgtttttaaaatcacatcagaacttttcctctactaagattataaattaaatgtaaaatactcctaattgcaattcttaaacttaggccttacatgtacttattatgcaactgctcctggactctattcaccatagatatcagtaaacgtatgtcccaggattcacaggcttttgattaatcaatattcttttcaagtttgctgtgaagagtttagttctcttcaaaatttcttaactaatctgatttttaagaattctctttgcagtgtttagcttcctattcacattcttaaaattgctttggtgttaccatgagtctaaaatgaagtttagccttccttttgtttcattctgagaacttctatattatattacctttaaaaattgtttatgatattaaatttaaaatacaaacagctctctttttttttttttttttttttaatcatccagcccaaagtggcaaaaacagctcttttctcatttggcaccaccaataacgcaagttaaaaataatgttgagtttattatacttttgacctgtttagctcaacagggtgaaggcatgtaaagaatgtggacttctgaggaattttcttttaaaaagaacataatgaagtaacattttaattactcaaggactacttttggttgaagtttataatctagatacctctactttttgtttttgctgttcgacagttcacaaagaccttcagcaatttacagggtaaaatcgttgaagtagtggaggtgaaactgaaatttaaaattattctgtaaatactatagggaaagaggctgagcttagaatcttttggttgttcatgtgttctgtgctcttatcatcacacaggtcatgtgttgttactcaggattctggaagtactaagccgtagttaacaggctggatagatcttcagccaatcttctttcattatactgctgcttttctgtttcttaaaaaacaaaaatcaatgaacaacttcttcagaaggaagcaccactgttcaattggttaactgaaagtatgaatcactgccgctttgcttgcccacctgtttgctttttctcacaggttttatttatctgaatgattgttgcatttgaatactgtagccatggtgagtgagcagttgaagacttcctttctgcaccttcatagttaagggttcatcttctcaagaaataaagttgtgctgggttgtttcaattctgtagatcacctagaaactaggtaacaaggcccttggatcacaatgagcacattgcaggtctttggaaatgctgggaaggggttacattcaagtaactgctgacgtccttcctctctgtcagacccatgttggcctgtaattatatttttctgaatctaaaaacaaatagaaatttctgatatct

SEQ ID NO: 6307 - DNA, 3120 bp, Homo sapiens
gggggcggggccgcgcggagggcaagccgggggcggggccggggccagagcagatctccgggcctccgcggccatagctgactgtgccgtcccttcccctcacccgctccacgccctcctgggccgagtggagttgggtggtgtcgggagcctctccctgaggggcaccgcgtcttcaggagctgggcctccagtgcggcgcgatgtcaggcgcggtgacagctctgtgagtccgaggccgcggccgtggcgctgggcggctgcggggcctgaccggtccgctcatggtgccgccacgacgccatcgcggggcaggaaggccaggtaggcaggcagggaagggccccgacatcaccggagcccaaaccgggacggagtgcccaccagcagcaccacctcctgccctcggtggcagcaggagcgccttgaccgaaaccgtgaaggtctctaggggcggagggagcgggagctgacaggggcgccggagccctgcgcccaccgctggcaattgaggaagccgtgcgtgcgccctcgcctcggctccccggggaggcgtcgctgccttaactgtcttccccgctccaaaacagaaggatgatttcttttcccagctgtttcttttaaaatgactggatgttttgatagaggtgggtggaggagcatggagaatccttttcttttaccacttgaagagattggaaaggtgccttcaagacccacagcaaatcacttactctccgataaccaaattccactccagcagatcagggacagaaaagacacttttagaaacagtgtctagacgctgtccccagggatggattcctctggatggagaggggtgctgagttcttcacctccttttagactgagatctgccaagttttccggcattgctcttgaggatctcagaagggctcttaagacaagactgcaaatggtgtgtgtatttgtcatgaaccgaatgaattcccagaacagtggtttcactcagcgcaggcgaatggctcttgggattgttattcttctgcttgttgatgtgatatgggttgcttcctctgaacttacttcgtatgtttttacccagtacaacaaaccattcttcagcacctttgcaaaaacatctatgtttgttttgtaccttttgggctttattatttggaagccatggagacaacagtgtacaagaggacttcgcggaaagcatgctgctttttttgcagatgctgaaggttactttgctgcttgcacaacagatacaactatgaatagttctttgagtgaacctctgtatgtgcctgtgaaattccatgatcttccaagtgaaaaacctgagagcacaaacattgatactgaaaaaacccccaaaaagtctcgtgtgaggttcagtaatatcatggagattcgacagcttccgtcaagtcatgcattggaagcaaagttgtctcgcatgtcatatcctgtgaaagaacaagaatccatactgaaaactgtggggaaacttactgcaactcaagtagcgaaaattagcttttttttttgctttgtgtggtttttggcaaatttgtcatatcaagaagcactttcagacacacaagttgctatagttaatattttatcttcaacttccggactttttaccttaatccttgctgcagtatttccaagtaacagtggagatagatttaccctttctaaactattagctgtaattttaagcattggaggcgttgtactggtaaacctggcagggtctgaaaaacctgctggaagagacacagtaggttccatttggtctcttgctggagccatgctctatgctgtctatattgttatgattaagagaaaagtagatagagaagacaagttggatattccaatgttctttggttttgtaggtttgtttaatctgctgctcttatggccaggtttctttttacttcattatactggatttgaggacttcgagtttcccaataaagtagtattaatgtgcattatcattaatggccttattggaacagtactctcagagttcctgtggttgtggggctgctttcttacctcatcattgataggcacacttgcactaagccttacaatacctctgtccataatagctgacatgtgtatgcaaaaggtgcagttttcttggttattttttgcaggagctatccctgtatttttttcattttttattgtaactctcctatgccattataataattgggatcctgtgatggtgggaatcagaagaatatttgcttttatatgcagaaaacatcgaattcagagagttccagaagacagcgaacagtgtgagagtctcatttctatgcacagtgtttctcaggaggatggagctagttagctgtctgttgtctgtagcccagcttgataatggaactatacagcgaagagacaatctctgcactttgctatgtagctgtgtacatatcactacagttataggaagtttcagtctacagtccatccaaaggaccaacctgccttacacatctcaaggaattcagctgttgaaatcatttgaactaatcaaggaataaatcctaatgttctgggactttattttcacatgttaaatgctggaatatattatgaaaatgttttcaagaaatcacttaagtgttcatagaccagtatttctgacaggtaaaatgctaaaataagctacctgtaataagtgtggattatatttttgggttttgtagaatattgcaaattaaccacacaaaaaatgtttaatttatgcaacaagcatgtttgtgcaaatttcatgggactttaaaaagaataagtatttgagaaaatatctggttcacttacactacatttactgtattattcttttatagcattaggtgccttgtattttaaatctgtgacaaaccatggcaaatttttaaaggggaagtattattataaaatgaagaaatatgtatttctaaaggctatattgctgtaaacttaattgataaagctctgtttaatttagagttttgaagaaatagtctcccttcaattaagaaattttcataatggaatgatttaaattgaagtgacaaagagtattattaaaatacaatgtttatacgtcta

SEQ ID NO: 6308 - DNA, 3490 bp, Homo sapiens
agcccaggcgctgctgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggttttttttgttgttgttgttggggtcaagttggtgagaggagagctcattgtttgaagaaaaaccaaaacattttatggctagtaatatttatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataatgctttatgttatacattaaatgtaaagacttgtgaatccatgtttgattgactttcatagtttcctgcattgaaataaaatcactatgaattctagtttatcagcatgatgttaaatgtcagtgccataccatgatgcagcaccatgacactaacgccatgaattcaaacagcacgttttacacctggaacttcatcagaccaatactttgcagttagagagaatttaatatctagaaaagcttgggaggttagtcaggacttagggagtatacataaatggttacttgttgtaatgagccctttattggtgaggttgcaatagcttccagctcttactgtgtcagatgaagcatctgtcattatcttaagcctgcagagttgaaaggttataggctctttcctaccctctcatcataatttttccaaagcaaagaggaacttggcttctggggttcgtgccttagtgagaaagaatcttttccaatagttccaatgggggaatttttggcttgctgattttatcaattgccttgacacctgacaaaccctaaatgaagtctatgtaggtgagtcatctctgttccacctgatttacagtattggaatttagacttgcaaaaacatcattctgcaaatatcttagataattacagaatcaggagcatttgagaactctagaggtctcagaaatcatcacataggggccatgcttcgtagatagggatgatagagaggagacctgcccaagttgaatttccatggccttcctcccttccttagttccatgataaagtatggacagtaaaccactacttgagctacctaaggtgaattaactctcagggaaccctcttccagttctttaccttgcacagtgaaagaatcagtggcacctagaaagttaaatccctttaggcccatacactagagacatgttttgtttgaacaatgtagtttaagtacttgaatgtcacactatataactgaggttagagaaaatgtttcttctagcccttacagggtgtgattcttaaacacaatgtccaaggtgtatacaaggatatgtattgtaacaactatgggtatgtatattttgcagagcgtagtttctatatcttgaaaaggaaaatattttcataaattgtttttataagtactaataaaataatatgaaagaaagcta

SEQ ID NO: 6309 - DNA, 2402 bp, Homo sapiens
agcccaggcgctgctgctggcgccagacggcaccggccgctggtagagcgcgtgccgcgagatgcggcctcaggacagcaccggggtcgcggagctccaggagcccgggctgccgctaacggacgatgcacccccgggcgccactgaggagccggcggccgccgaggcagctggggcgccagaccgcggtaggtgctggctctgcctttcctcgccgtgttgctcccgcaccgagccggaagccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaaaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggttttttttgttgttgttgttggggtcaagttggtgagaggagagctcattgtttgaagaaaaaccaaaacattttatggctagtaatatttatgtaatttttaaaatgtatttttggtactgatgggatatgggtggggaggctattttagatattcttttagcagtgtagagcctaagaaacttggttctactaccatgatctttataaactatgccttccagacaattgataatgctgctataattagtattatgttgataattcatttgcaaccttattctatttaggaggatgaagttgaagcttagaataggtgcctgcttaatggtgttaataatacaaatgaattggccttattttcaaggattttataaatgattatcatacttgtaactcatatttgtgccttttcattttaatgctggaatttttattatgtcacctctaaaacacttaaattgccaaatttggctagtagttttgtttcagtggcattagcaactgcagctagcatactataattttaattgtcctcacttttttttgaaactgcactaaatttttcttaacattccaagatttcagatctctaaatcacaaagagaaatcttggcatgaccagtgtgcacgtttccatcctgaagtgttttctcttcactagaaatgtgattttctataaattccccttgaatttatagtgtgatgccaaataaaattttctcaggatcttattaggttgaaccatatgtaattgccaagattttactattttaacttagaaaaaccatcgtttcatatgattcaccctaatagatacctccattattctctaaatgaaatagaagactttggagtatatgtttttaaagtaattttttaaaatatggtaatgtattaaacttatttttatagttatgaaattatgtgtaataatgctttatgttatacattaaatgtaaagacttgtgaatccatgtttgattgactttcatagtttcctgcattgaaataaaatcactatgaattct

SEQ ID NO: 6310 - DNA, 1874 bp, Homo sapiens
ccccactccaatgaggtcacaatggctggagctctgaggggcccaggctccctgagccaggaggagaggagaaagtccaaggaaagatggctggcagtcacccctatttcaaccagcctgactccacacacccatcgccgccctccgctccacccagcctccgctggtaccagcgctgccagccctctgatgccaccagtggcctgctggtggccctgctgggtgggggcctgcctgctggcttcgtgggccccctttctcgtatggcttaccaggcttccaacctgccctcgctggagctgctcatctggcgatgcctcttccacctccctattgccctgctacttaaactgcgtggcgacccccttctgggaactcctgacatccgaagccgggccttcttctgtgccctgctcaacatcctcagcattggatgtgcctacagtgcggttcaggtggtgcccgctggcaacgctgccactgttcgcaaaggttcttccaccgtctgctccgccgtcctcactctctgccttgagagccagggtctcagtggctacgactggtgtggactgttgggctgcatcctaggactaatcatcattgtgggacctggactctggacactacaggaggggaccacgggtgtctacaccgccctgggctatgtggaggctttcctgggaggcctggcgctgtccctgaggcttctggtctatcgttctctgcactttcccccctgcctcccaacagtggccttcctatctggcttggtggggctgctgggctctgtgccaggcctctttgtgctgcaggcccccgtgttgcccagtgacctcctgagttggagttgtgtgggggcagtggggatcctcgccttggtctccttcacatgtgtgggctatgcggtcaccaaggcccaccctgccctggtgtgcgctgtcctacattccgaggtggttgtggcccttatactgcagtattatatgctccatgagactgtggcaccttctgacatcgtggcggcaggggttgtgctgggcagcattgccatcattacagcccagaacctcagctgtgagaggacagggagggtggaggagtgagatagaacttgggagcccgggggttgggagggacagggataaataaaggcaaagactgaagacaaacatgggaggagaagtgactggaaaagaactggtgtgggagagggatacctctcagagtcaagggtgacttggggacttggtggagagggactacgtggaagacctggggccagcctgggaccaagggatgtggagtccaggctgggtcctagaatcagggcataactaaggggtaaagtctgaggagcagatccaaagggctgaggcagggaggccgtgggccatggggaggacttcactcagcagcaaagagaagagcattggggctggagtgttccggcaaagacagagccagcagctgcgctgggggagggaagcgtgcctccccacccctcccctcacggggaaggtttcctttcctcgtgcttgtgccccccgcttggggtggtgacgtgacattgacatcaaacaaggattacagtgaatgtgaaaaaaaaaaaaaaagatacctgaatagacatttctatgacattttaaaagccatgaatttattttggcacaaatattttatcatatgcagtcacttctttgtaaatgattttttgtaaagtcattggatataaaagagtgattttcctcacctgagtacatgaaaagaaaatgctgaaatcaatgtataaatcaaatcatctgtactagcactgttaatctagaagaaagtggttgcatagagaagagtaagaatgtagaccagcttattgaagt

SEQ ID NO: 6311 - DNA, 1321 bp, Homo sapiens
gcgagaaacacccaagaatgatcaattaaaaaaaaaaaaaagaaagaaagaaagaaagaaaagaagcagagttggactcagcgggaaaataggcgtgctaccacctcaggagagttccagggaagaaccccacccgcactccaatgaggtcacaatggctggagctctgaggggcccaggctccctgagccaggaggagaggagaaagtccaaggaaagatggctggcagtcacccctacttcaacctgcctgactccacacacccatcgccgccctccgctccacccagcctccgctggcaccagcgctgccagccctctggtgccaccaatggcctgctggtggccctgctgggtgggggcctgcctgctggcttcgtgggccccctttctcgtatggcttaccagggttccaacctgccctcgctggagctgctcatctgtcgatgcctcttccacctccctattgccctgctacttaaactgcgtggcgacccccttctgggacctcctgacatccgaggctgggcctgcttctgtgccctgctcaacgtcctcagcattggatgtgcctacagtgcagttcaggtggtgcccgctggcaacgctgccactgttcgcaaaggttcttccaccgtatgctccgctgtcctcaccctctgccttgagagccagggtctcggtggctacgagtggtgtggactgttgggcagcatcctaggactaatcatcattctgggacctggactctggacactacaggaggggaccacaggtgtctacaccaccctgggctatgtgcaggctttcctgggaggcctggcgctgtccctggggcttctggtctatcgttctctgcactttccctcctgcctcccaacagtggccttcctatctggcttggtggggctgctgggctgtgtgccaggcctctttgtgctgcagacccccgtgttgcccagtgacctcctgagttggagttgtgtgggggcagaggggatcctcgccttggtctccttcacatgtgtgggctatgcggtcaccaaggcccaccctgccctggtgtgcgctgtcctgcattccgaggtggttgtggcccttatactgcagtattatatgctccatgagactgtggcactttctgacatcatgggggcaggggttgtgctgggcagcattgccatcattacagcccggaacctcagctgtgagaggacagggaaggtggaggagtgagatagaacttgggagcccgggggttgggagggacagggataaataaagacaaagactgaagacaaaaaaaaaataaaagaaaaaa

SEQ ID NO: 6312 - DNA, 2772 bp, Homo sapiens
agtggcggggaagcaaagcacaggagcgctgtggtgccagcggccgggctagggacgactggcgggtttgcgctggacccgaccccgagggcgggcgcaagggggcgggcgctgccgtactcaggccgcggggccagggcgggccggccggcggggcatttaaaccccgctgacagccagtccagcccgggacacgcgcccagctctgtagcctcctccgtcgactcagccttaggtaccggtcaggcaaaatgcggtcctccctggctccgggagtctggttcttccgggccttctccagggacagctggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcatagatgttcctgtacaactacattggccaggacgggattgccagctccatagtgatgctgatcatctgtgggggcctggtcaatggcccatacgcgctcatcaccactgctgtctctgctgatctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcgggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcagactcttgcttgttcagattccaagacagaaggcttcacaaggccaacgcctggaaaatgggcatctctccttcccatgttaagctttaacctctgtaatctgcctgtatctataggtgggcatctcactccaccaaaggagcccagcctctctttgtccctctatccatgcaacagtcttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgc

SEQ ID NO: 6313 - DNA, 2696 bp, Homo sapiens
gtcgactcagccttaggtaccggtcaggcaaaatgcggtcctccctggctccgggagtctggttcttccgggccttctccagggacagctggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcataggcggcatcgtggcagggctcgtctctgactacaccaatggcagggccaccacttgctgtgtcatgctcatcttggctgcccccatgatgttcctgtacaactacattggccaggacgggattgccagctccatagtgatgctgatcatctgtgggggcctggtcaatggcccatacgcgctcatcaccactgctgtctctgctgatctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcggctctagtatggtcctaacccaccagtgatagtattttcctcaagtcccatgacttttgtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcagactcttgcttgttcagattccaagacagaaggcttcacaaggccaacgcctggaaaatgggcatctctccttcccatgttaagctttaacctctgtaatctgcctgtatctataggtgggcatctcactccaccaaaggagcccagcctctctttgtccctctatccatgcaacagtcttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgc

SEQ ID NO: 6314 - DNA, 2908 bp, Homo sapiens
agaaagtgcagggcggaatgaggagccccagcacctcagagctgtcgggcagtggcggggaagcaaagcacaggagcgctgtggtgccagcggccgggctagggacgactggcgggtttgcgctggacccgaccccgagggcgggcgcaagggggcgggcgctgccgtactcaggccgcggggccagggcgggccggccggcggggcatttaaaccccgctgacagccagtccagcccgggacacgcgcccagctctgtagcctcctccgtcgactcagccttaggtaccggtcaggcaaaatgcggtcctccctggctccgggagtctggttcttccgggccttctccagggacagctggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcataggcggcatcgtggcagggctcgtctctgactacaccaatggcagggccaccacttgctgtgtcatgctcatcttggctgcccccatgatgttcctgtacaactacattggccaggacgggattgccagctccatagtgatgctgatcatctgtgggggcctggtcaatggcccatacgcgctcatcaccactgctgtctctgctgatctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcgggtataaagaaatatgaggccccaattggaacagcagcatggagggtcccagttgggtccccaacgtgctccccatgggcaagacaatggaaacttccacaagcagggaaggcaaaccctctttattgaacattagccagcccagcccagaccccagggctgcctaaggacacagagattctccatgggaaggggactgccaagcatgaggaaatagaagattcaggggcctgagctctggaagctgcaagcaaaagggatgggactagggctgagttgtgtctccattttgataaggaaaggatatgctcagactcttgcttgttcagattccaagacagaaggcttcacaaggccaacgcctggaaaatgggcatctctccttcccatgttaagctttaacctctgtaatctgcctgtatctataggtgggcatctcactccaccaaaggagcccagcctctctttgtccctctatccatgcaacagtcttctctgtgcatttccccaagctgggccctcttctactctccatttaggcctgttgataactccattacccgcccatcactgctgttcctccagggccagcactcgggcgaggcaggggagctgccttcggtacataatttgaaggggcactccctcttgggcacatgccggccctgagtgcctcccttgcctcactctgatcctggccccataatgtcctcagtggaaggtgatgggggccggtgctgtggggagagtagaaagaggggttggcatgactaaaaataccagtatgtgtattaagtattttgagaatgaaatgccaaggagtgcctactatatgccagctctaggaatggagtagacagtggacacaagaaggacttacgccctgagcacaggtgccaatggtgacaagactggcaagacgtgagggcatgaatggttcattcaggcagctgctgcagatgtggtcacctggtgccatctgctgctcccttttccacttttctatgtcctccttccaccccaagtcccggatcactcgctgttttctggctagctcttggcatctccatctgagcctaaagttgcccactggcaccaatagattctgtttgacctgc

SEQ ID NO: 6315 - DNA, 1769 bp, Homo sapiens
agtggcggggaagcaaagcacaggagcgctgtggtgccagcggccgggctagggacgactggcgggtttgcgctggacccgaccccgagggcgggcgcaagggggcgggcgctgccgtactcaggccgcggggccagggcgggccggccggcggggcatttaaaccccgctgacagccagtccagcccgggacacgcgcccagctctgtagcctcctccgtcgactcagccttaggtaccggtcaggcaaaatgcggtcctccctggctccgggagtctggttcttccgggccttctccagggacagctggttccgaggcctcatcctgctgctgaccttcctaatttacgcctgctatcacatgtccaggaagcctatcagtatcgtcaagagccgtctgcaccagaactgctcggagcagatcaaacccatcaatgatactcacagtctcaatgacaccatgtggtgcagctgggccccatttgacaaggacaactataaggagttactagggggcgtggacaacgccttcctcatcgcctatgccatcggcatgttcatcagtggggtttttggggagcggcttccgctccgttactacctctcagctggaatgctgctcagtggccttttcacctcgctctttggcctgggatatttctggaacatccacgagctctggtactttgtggtcatccaggtctgtaatggactcgtccagaccacaggctggccctctgtggtgacctgtgttggcaactggttcgggaaggggaagcgggggttcatcatgggcatctggaattcccacacatctgtgggcaacatcctgggctccctgatcgccggcatctgggtgaacgggcagtggggcctgtcgttcatcgtgcctggcatcattactgccgtcatgggcgtcatcaccttcctcttcctcatcgaacacccagaagatgtggactgcgcccctcctcagcaccacggtgagccagctgagaaccaggacaaccctgaggaccctgggaacagtccctgctctatcagggagagcggccttgagactgtggccaaatgctccaaggggccatgcgaagagcctgctgccatcagcttctttggggcgctccggatcccaggcgtggtcgagttctctctgtgtctgctgtttgccaagctggtcagttacaccttcctctactggctgcccctctacatcgccaatgtggctcactttagtgccaaggaggctggggacctgtctacactcttcgatgttggtggcatcataggcggcatcgtggcagggctcgtctctgactacaccaatggcagggccaccacttgctgtgtcatgctcatcttggctgcccccatgatgttcctgtacaactacattggccaggacgggattgccagctccatagtgatgctgatcatctgtgggggcctggtcaatggcccatacgcgctcatcaccactgctgtctctgctgatctggggactcacaagagcctgaagggcaacgccaaagccctgtccacggtcacggccatcattgacggcaccggctccataggtgcggctctggggcctctgctggctgggctcatctcccccacgggctggaacaatgtcttctacatgctcatctctgccgacgtcctagcctgcttgctcctttgccggttagtatacaaagagatcttggcctggaaggtgtccctgagcagaggcagcggctctagtatggtcctaacccaccagtga

SEQ ID NO: 6316 - DNA, 3349 bp, Homo sapiens
gggtcacgtgggcgtccggaaaccctggtcgcaccgccaggggtgagctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgttctccaaatgataagtccatcaatgcccttctgatgactgttacaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaa

SEQ ID NO: 6317 - DNA, 2955 bp, Homo sapiens
gcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcatagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaa

SEQ ID NO: 6318 - DNA, 1573 bp, Homo sapiens
ggtgagctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtgacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggaaaactctgagctccttttagtgagtgaaaggagaacagtactgccgtttgagtcctgtcgacattgtagccagcccctggcacagctggacgtgtttgaggggagtgatgcacgtcttttatagatacaggaaaatcttcgcatttgcaaattatttttataattgagacactggcaaggaatgaacatagatgtatttctgatttcacttcttgaaacatttcttttcatccataaaaatgatgcacaaaaaagatacttaacctgtagttaaatacagattacatacaaatgaaaccacagaagcaaacagatgtacaattcttctatcttttgagtatttttagatagactgtgtgactttaattgaccttagttgacctcggtctctggaccttcgttgctgcttctgtaaaatggaaataaaaataacatcacctcataagtagggatgtatgcagagcccttcacacgtggtaggcactccataaacagtggctgtcgctgttattttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaa

SEQ ID NO: 6319 - DNA, 3254 bp, Homo sapiens
ctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctggctccccttttatctgagtaacaacttcggctggaaggaggcggaagccgacaagctgtccatttggtacgacgttggagggatcataggtggaactttgcaaggcttcatctctgatgtactacagaagagagcgccggttcttgccctgagtctgcttctggcagttgggtccctcatcgggtatagtcgattttttattggtggaccttctaatatgattagttctgctatttctgcggacttgggtcgccaggagctcatccaaaggagcagtgaagctttggccactgtcacaggaattgtggatggttcggggagcattggagctgcagtgggccagtatttagtgtctctgatccgggacaagctaggatggatgtgggttttctactttttcattctcatgacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaa

SEQ ID NO: 6320 - DNA, 544 bp, Homo sapiens
gccttgctgggaggcacaggcagcgtccaccccgatgatgtcctcccgccggcatcccgcagccttcgccttcctggttcacctgtcgcttacctgtctcgctctctcacctctgctggtcagcagatctgaatatctctttgtgaggagtcagagaaaggagatgatgcaaagagaaggaagcaaaaacaaaactaaaagaactttgaaggtatatgagaagaaaaagctgaaaagaaaatgtctgcctcactccctcaaaaattctaccatagagcaaaggttgacgtccagaaaacctcaagtttatcagtcccagatgctggcagtagaagcataaagctgagctaacattactggccaggtccgcagcagcagagttctgtgggctcccagcctccgccctcctcgccctcctccgcgccggcagaaggaagaaatgatgtaaatcactcatccaaaccttaaggtcaaaggtgagaaggaaggtcaggaagaacatggcctggccaaatgtttttcaaagagggtctctgctgtccca

SEQ ID NO: 6321 - DNA, 1186 bp, Homo sapiens
gggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcagttattcgttgctccatgcttcacgaaaaacatttagcaatgtcaaagtcagtatctctgagcagtggaccccaagtgcttttaacacgtcagttgagctgcctgtggagatctggagcagcaaccatttgttccccagtgcagagaaagcgactcttttcctcggcacactggataccattttcctcttctcctatgctgtgggcctattcatcagtggcatcgttggggatcggttgaatttgcgatgggttctgtcttttggcatgtgctcttctgcattagtggtgtttgtctttggtgcgctcacagaatggctgcgtttctacaacaaatggctgtactgctgcctgtggattgtgaacggcctgctgcagtccactggttggccctgtgtggttgctgttatgggcaactggtttgggaaagccggacgaggagttgtttttggtctctggagtgcctgtgcttcggtgggcaacattttgggagcgtgcctagcttcttctgttcttcagtatggttatgagtatgcctttctggtgacggcgtctgtgcagtttgctggtgggatcgttatcttctttggactcctggtgtcaccagaagaaattggaaaactctgagctccttttagtgagtgaaaggagaacagtactgccgtttgagtcctgtcgacattgtagccagcccctggcacagctggacgtgtttgaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccgtactcactggcctacgcctgcttgaagttagtgaattactccttcttcttctg

SEQ ID NO: 6322 - DNA, 2708 bp, Homo sapiens
gtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggagggtaaggcctccgccctacagccgcctgcctcaggcccagggagcggcagccccctcccccagccctggggtgatgcccaggtcatcctcgggagccctgccaggccccccttctctttccagccgcctgctgagcagacccctcggagagctttctgctcccttcccatcagcagcttgctttctgggaaccttttatctgccttactcccctttaaacacctgcggcatcgtcacatggcttgtgattaccgttttatctcccttgctcccctttaaaacacctgcggcattgtca

SEQ ID NO: 6323 - DNA, 4300 bp, Homo sapiens
aagtgtgagcgccgcggcggcagctgagttgggctgaggtgtccctagctggctctgcggctcttccgggtctgggctcggagattcacaggcggcccgcgaggccgagcgagggacgcatggccctgaggcggccgcagggcttggcggggtccggaggttgacctcgcccccgcagccggccttcgaggctgcctcctccaggcagcctctggggcccgcgcccgcgcctgctcaggctcccgtgttcaggctgcccatcccctccccaccggcgtcccggacgttgggacctgtgaccgtggcctcgggctgggcttccaaagccggccgcagcccggcgacccccgaggcctctcgccccgggcccctagacctctcactatgaccgcggccgccgcctccaactgggggctgatcacgaacatcgtgaacagcatcgtaggggtcagtgtcctcaccatgcccttctgcttcaaacagtgcggcatcgtcctgggggcgctgctcttggtcttctgctcatggatgacgcaccagtcgtgcatgttcttggtgaagtcggccagcctgagcaagcggaggacctacgccggcctggcattccacgcctacgggaaggcaggcaagatgctggtggagaccagcatgatcgggctgatgctgggcacctgcatcgccttctacgtcgtgatcggcgacttggggtccaacttctttgcccggctgttcgggtttcaggtgggcggcaccttccgcatgttcctgctgttcgccgtgtcgctgtgcatcgtgctcccgctcagcctgcagcggaacatgatggcctccatccagtccttcagcgccatggccctcctcttctacaccgtgttcatgttcgtgatcgtgctctcctctctcaagcacggcctcttcagtgggcagtggctgcggcgggtcagctacgtccgctgggagggcgtcttccgctgcatccccatcttcggcatgtccttcgcctgccagtcccaggtgctgcccacctacgacagcctggatgagccgtcagtgaaaaccatgagctccatatttgcttcctcccttaatgtggtcaccaccttctacgtcatggtggggtttttcggctacgtcagcttcaccgaggccacggccggcaacgtgctcatgcactttccctccaacctggtgacggagatgctccgtgtgggcttcatgatgtcagtggctgtgggcttccccatgatgatcctgccatgcaggcaggccctgagcacgctgctgtgtgagcagcagcaaaaagatggcacctttgcagcagggggctacatgccccctctccggtttaaagcacttaccctctctgtggtgtttggaaccatggttggtggcatccttatccccaacgtggagaccatcctgggcctcacaggagcgaccatgggaagcctcatctgcttcatctgcccggcgctgatctacaagaaaatccacaagaacgcactttcctcccaggtggtgctgtgggtcggcctgggcgtcctggtggtgagcactgtcaccacactgtctgtgagcgaggaggtccccgaggacttggcagaggaagcccctggcggccggcttggagaggccgagggtttgatgaaggtggaggcagcgcggctctcagcccaggatccggttgtggccgtggctgaggatggccgggagaagccgaagctgccgaaggagagagaggagctggagcaggcccagatcaaggggcccgtggatgtgcctggacgggaagatggcaaggaggcaccggaggaggcacagctcgatcgccctgggcaagggattgctgtgcctgtgggcgaggcccaccgccacgagcctcctgttcctcacgacaaggtggtggtagatgaaggccaagaccgagaggtgccagaagagaacaaacctccatccagacacgcgggcggaaaggctccaggggtccagggccagatggcgccgcctctgcccgactcagaaagagagaaacaagagccggagcagggagaggttgggaagaggcctggacaggcccaggccttggaggaggcgggtgatcttcctgaagatccccagaaagttccagaagcagatggtcagccagctgtccagcctgcaaaggaggacctggggccaggagacaggggcctgcatcctcggccccaggcagtgctgtctgagcagcagaacggcctggcggtgggtggaggggaaaaggccaaggggggaccgccgccaggcaacgccgccggggacacagggcagcccgcagaggacagcgaccacggtgggaagcctcccctcccagcggagaagccggctccagggcctgggctgccgcccgagcctcgcgagcagagggacgtggagcgagcgggtggaaaccaggcggccagccagctggaggaagctggcagggcggagatgctggaccacgccgtcctgcttcaggtgatcaaagaacagcaggtgcagcaaaagcgcttgctggaccagcaggagaagctgctggcggtgatcgaggagcagcacaaggagatccaccagcagaggcaggaggacgaggaggataaacccaggcaggtggaggtgcatcaagagcccggggcagcggtgcccagaggccaggaggcccctgaaggcaaggccagggagacggtggagaatctgcctcccctgcctttggaccctgtcctcagagctcctgggggccgccctgctccatcccaggaccttaaccagcgctccctggagcactctgaggggcctgtgggcagagaccctgctggccctcctgacggcggccctgacacagagcctcgggcagcccaggccaagctgagagatggccagaaggatgccgcccccagggcagctggcactgtgaaggagctccccaagggcccggagcaggtgcccgtgccagaccccgccagggaagccgggggcccagaggagcgcctcgcagaggaattccctgggcaaagtcaggacgttactggcggttcccaagacaggaaaaaacctgggaaggaggtggcagccactggcaccagcattctgaaggaagccaactggctcgtggcagggccaggagcagagacgggggaccctcgcatgaagcccaagcaagtgagccgagacctgggccttgcagcggacctgcccggtggggcggaaggagcagctgcacagccccaggctgtgttacgccagccggaactgcgggtcatctctgatggcgagcagggtggacagcagggccaccggctggaccatggcggtcacctggagatgagaaaggcccgcgggggggaccatgtgcctgtgtcccacgagcagccgagaggcggggaggacgctgctgtccaggagcccaggcagaggccagagccagagctggggctcaaacgagctgtcccggggggccagaggccggacaatgccaagcccaaccgggacctgaaactgcaggctggctccgacctccggaggcgacggcgggaccttggccctcatgcagagggtcagctggccccgagggatggggtcatcattggccttaaccccctgcctgatgtccaggtgaacgacctccgtggcgccctggatgcccagctccgccaggctgcggggggagctctgcaggtggtccacagccggcagcttagacaggcgcctgggcctccagaggagtcctagcacctgctggccatgagggccacgccagccactgccctcctcggccagcagcaggtctgtctcagccgcatcccagccaaactctggaggtcacactcgcctctccccagggtttcatgtctgaggccctcaccaagtgtgagtgacagtataaaagattcactgtggcatcgtttccagaatgttcttgctgtcgttctgttgcagctcttagtctgaggtcctctgacctctagactctgagctcactccagcctgtgaggagaaacggcctccgctgcgagctggctggtgcactcccaggctcaggctggggagctgctgcgtctgtggtcaggcctcctgctcctgccagggagcacgcgtggtcttcgggttgagctcggccgtgcgtggaggtgcgcatggctgctcatggtcccaacacaggctactgtgagagccagcatccaaccccacgcttgcagtgactcagaatgataattattatgactgtttatcgatgcttcccacagtgtggtagaaagtcttgaataaacacttttgccttcaccca

SEQ ID NO: 6324 - DNA, 3737 bp, Homo sapiens
agaaacatcctgcagcatctccgtctccggaggaaaaatacatttgtctgggcgaactccggtggaaaagcgccccaggctgccacagcctagagatcttggggctgcagccctcgcggcctgccgagggagcagggggcgcccgtggaactggctccctgcagctctgcggctacacgcggacctcggctgtgtgcgaggtggcggaggaggctggccgggtgcgaatccgtacccagccccagcatcttccacctgctgaggaccaccgctcagccatgggctaccagaggcaggagcctgtcatcccgccgcaggattgccttattcaatgaagcaagctgggtttcctttgggaatattgcttttattctgggtttcatatgttacagacttttcccttgttttattgataaaaggaggggccctctctggaacagatacctaccagtctttggtcaataaaactttcggctttccagggtatctgctcctctctgttcttcagtttttgtatccttttatagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgctttagtctgtatttatgttatataaaattattattttggcttttatcaagacttggcttttatgagtagtgcaatataaaagataaagaaaagaaaaattgaatgtatttcacctttaactggaacaaaataagggttttgttctaatgactgcactacactaatgctaattgaagaagggagagttaagcctttagcattttctgccatcccccttttatttaatatgcaaaccagtatattgtgctccaaaataagtaggtgattgtgggttggaattttgtgtagatgtcttttggtgggggggtgtggggggtgggcattttctttgtccttaaaagtctgtggaactgaagagaagggaaacccaaaacgattgaaaagaagacatatcccaagaacaaagaggagctctccgttataatttcagcagcatcctttgtttaaagggaaatggatccctggagaaatgagcaaagacctctccatgtgaggaatcctgaatcatagactggctgtgaggagcaaggtgtgtaaagaatcaaaatcacctcccatcttctgatgctgtgggaatacaatggtagcaccattctaaaacagaaaaacaaacaaacaaacaaaaaaaacaaaaacaaaaaacagttgttctgtggcaagaacctaagagattggtgatatggacctgttggatttttagtgctgtcaggaatgtacaactggaagctgaactttgaaactagaaacgtgtaagaagaatcagggctacagaagaagctttctcagtccactgggggttcctcagagagatttctgggagctcttgttgactgggtctttgggagcagatagtgagatggagtttatcataactaatgggagagaggggaaagcaggattgttagggagaggtagaactgcagtgcaggctgacctcagccaaatccacagggaagctggtgcatacatgacccatcagagttgtccctgttcaagggtaatagcccagttttgatactgctgcctccatcagtcatttaatgtgagcatctggagaaggatgagttcttgggctaggcagctctttgcagcagagcaaaccctaaaggaactgagagctcgaggtggtctactgatagctttgtcaccacatgcttccttacaggggtatctgggagacacagctgtgcccaccacagatgccctcggtttactgaggatttttaaatgattttttaatgaggactttgtgtctttgtatgtatgacaatcttcaaaaagtaacatgaaaatctggggccatctggatggcttccttatatcaagtatcacctaagattttcatttcatttgtattccaatcaggttgtccatctgtggcactatattaattgttgccaaataacgagaaactatcacaagcagagttaatacatatatgatgagtttgtacaaatcaaatgcaaaaagaaatcctacaggaagtgtataaagggtaggttcacagtagtttgaataaagtggcaagagctgagtcactgtgtgactcatagtgagaaaggcctattgaacataaaggaagatgcattttagcaggtagaaccatgctcagggttttagtggtgatttattttttcaataaaatattatccttaccattaaattaatttaaattctgttgggtaacttttctgtatttaacttataaatttgtttttttatagttaagggtcataggctaagcagtttgtgcctgtttttagattggtacatgtttaggtaaaatataataaaaatgctttcattccatgtaagaaatgaggaaatgtaagaaatttttgccacagtctgtcattacattgctcaagactgagaaacactgacctacataattattaaataaagtcatgagggatgagatctctaagcatgtacaaagaaaagtatgtcaaggataacataatttagcacgtaaccatctcttatcttgtactttggtgttgcttcatactcttcaagtagatgaaagctcctggtaggaactgagcgcagcattagtgcctaataaacatgtattggtttatttatttttaatcagctgtagaacaagactgcttatgacccagttattagctgcacggattaccgacatctttcaaattataatttaataaatcttaggaactca

SEQ ID NO: 6325 - DNA, 1621 bp, Homo sapiens
acatttgtctgggcgaactccggtggaaaagcgccccaggctgccacagcctagagatcttggggctgcagccctcgcggcctgccgagggagcagggggcgcccgtggaactggctccctgcagctctgcggctacacgcggacctcggctgtgtgcgaggtggcggaggaggctggccgggtgcgaatccgtacccagccccagcatcttccacctgctgaggaccaccgctcagccatgggctaccagaggcaggagcctgtcatcccgccgcaggattgccttattcaatgaagcaagctgggtttcctttgggaatattgcttttattctgggtttcatatgttacagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgctttagtctgtatttatgttatataaaattattattttggctttta

SEQ ID NO: 6326 - DNA, 1542 bp, Homo sapiens
tgggctaccagaggcaggagcctgtcatcccgccgcagagagatttagatgacagagaaacccttgtttctgaacatgagtataaagagaaaacctgtcagtctgctgctctttttaatgttgtcaactcgattataggatctggtataatagtagccccattttgactccagagtctgtctttcttaatattccataacccttctgtgctccttattatcctctctgctttcttggctagcaggattgccttattcaatgaagcaagctgggtttcctttgggaatattgcttttattctgggtttcatatgttacagacttttcccttgttttattgataaaaggaggggccctctctggaacagatacctaccagtctttggtcaataaaactttcggctttccagggtatctgctcctctctgttcttcagtttttgtatccttttatagcaatgataagttacaatataatagctggagatactttgagcaaagtttttcaaagaatcccaggagttgatcctgaaaacgtgtttattggtcgccacttcattattggactttccacagttacctttactctgcctttatccttgtaccgaaatatagcaaagcttggaaaggtctccctcatctctacaggtttaacaactctgattcttggaattgtaatggcaagggcaatttcactgggtccacacataccaaaaacagaagacgcttgggtatttgcaaagcccaatgccattcaagcggtcggggttatgtcttttgcatttatttgccaccataactccttcttagtttacagttctctagaagaacccacagtagctaagtggtcccgccttatccatatgtccatcgtgatttctgtatttatctgtatattctttgctacatgtggatacttgacatttactggcttcacccaaggggacttatttgaaaattactgcagaaatgatgacctggtaacatttggaagattttgttatggtgtcactgtcattttgacataccctatggaatgctttgtgacaagagaggtaattgccaatgtgttttttggtgggaatctttcatcggttttccacattgttgtaacagtgatggtcatcactgtagccacgcttgtgtcattgctgattgattgcctcgggatagttctagaactcaatggtgtgctctgtgcaactcccctcatttttatcattccatcagcctgttatctgaaactgtctgaagaaccaaggacacactccgataagattatgtcttgtgtcatgcttcccattggtgctgtggtgatggtttttggattcgtcatggctattacaaatactcaagactgcacccatgggcaggaaatgttctactgctttcctgacaatttctctctcacaaatacctcagagtctcatgttcagcagacaacacaactttctactttaaatattagtatctttcaatgagttgactgctttaaaaatatgtatgttttcatagactttaaaacacataacatttacgcttgc

SEQ ID NO: 6327 - DNA, 1688 bp, Homo sapiens
gtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttggggcattcgttttgctcatctttggaattttggttgggaattttagtttagcactcatcatttttgattggattaataaataaaagaaatattttcctacttcttacaagaataatatacccctagttgcaagaatgaattattccggaagacaccctggatgaaaaataacattttaataaaaattattaacagaaaagcagaacaaaatggcagtgggtatggggaagtaagagtgtggcagttttaatcaaaaaaagaaacaaactcgaaatgctcttaaa

SEQ ID NO: 6328 - DNA, 1750 bp, Homo sapiens
gtcatcagatcaagtcgactcgctcctctccttccaggccctggtgaagtacggaatgccggaagggccgggctcaaagctccgcctctggcgcgaccgacgactggagcgcagggcaggggtagaggctcgtagatggaactggtagtcagctggagagcagcatggaggcgtcctgggggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttgggggtctcattctgtcgcacaggttggcgtgcagtggtgtgatctcagctcattgcaacctctgcctcccggactcaagcaatcctcccacctcagcctccagagtagctgagactacaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccc

SEQ ID NO: 6329 - DNA, 1568 bp, Homo sapiens
gggagcttcaacgctgagcggggctggtatgtctctgtccagcagcctgaagaagcggaggccgaagagttgagtccgttgctaagcaacgaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttgggggtctcattctgtcgcacaggttggcgtgcagtggtgtgatctcagctcattgcaacctctgcctcccggactcaagcaatcctcccacctcagcctccagagtagctgagactacaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatca

SEQ ID NO: 6330 - DNA, 1734 bp, Homo sapiens
aaataagacccagaaaaggaggaccgcaccgggacaggggagatgctggagcctgaaccctgggggatggggtctgaaggcagccgccgagattcagatgagattggcgcagttatgaacgtgatagcagcctagcatactctagaaagaaaagatgaaaagcgtcgggtggaagagatgcagcgttgagtggaagctgcgaacatgatgggatgagcggccctaggattatgtactcactgctgttagaacttcacagacagcgatccccaggtgtttcatttggtttatcagtgtttaatttgatgaatgccatcatgggaagtggcatccttggcttagcttatgttttggctaataccggtgtctttggatttagcttcttgctgctgacagttgctctcctggcttcttactcagtccatcttctgcttagtatgtgtattcagacagctgtaacatcttatgaagatcttggactctttgcatttggattacctggaaagttggtggtggcaggcaccataataattcagaatattggagctatgtcatcttatcttttaattattaaaacagagcttcctgctgctattgcagaatttttgactggagactatagtagatattggtatcttgatggacaaacactactaataatcatatgtgttggcattgtgttccctcttgcacttcttcccaaaataggctttcttggctacacaagtagtttatcatttttctttatgatgttctttgctcttgtggtaataattaaaaaatggtccatcccttgtcctctgacattaaattatgtagagaaaggtttccagatttcaaatgttacagatgattgtaagccaaagctctttcatttctccaaagagagtgcttatgccttaccaaccatggctttttcatttctctgccatacctcaatattgcccatatactgtgaacttcaaagtccttcaaagaaaagaatgcagaatgttaccaatacagcaattgctttaagttttctcatttattttatatctgcactctttgggtacctcactttttatgacaaagtggagtcagaattactaaaaggttatagtaaatacttatcacatgatgttgttgtcatgactgtgaagttatgcatactatttgctgtgcttttgacagtccctctaatccacttccctgccagaaaagctgtaacaatgatgtttttctccaattttccattctcatggattcgccattttttgatcactctagcactcaatattatcatcgttttacttgcaatatatgttcctgacattagaaatgtatttggtgtagttggtgccagtacatcaacatgtttgatttttatattcccaggactattttatcttaaacttagcagagaggattttctgtcatggaaaaagcttgggggtctcattctgtcgcacaggttggcgtgcagtggtgtgatctcagctcattgcaacctctgcctcccggactcaagcaatcctcccacctcagcctccagagtagctgagactacagaaaaggaagagataccatggagatgtgcacccagaggaaaggccacgcaaggacacagcaagaaggcaactgtttacaagccaagggaagaggcctcaggagaaccaaacgtgtccacaccttgatcttgcacttcccaacctccagaactgtgagcaaataaatgatgttgtttaatcaccc

SEQ ID NO: 6331 - DNA, 2368 bp, Homo sapiens
aggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtc

SEQ ID NO: 6332 - DNA, 2927 bp, Homo sapiens
ggtccaaggacgtaaccagatcatacaacacgcgccaggaaagcccaaaagaggggtgatccctcgatggaggtgccgcatcagcgttttctcacgtggcctccggggctctatgaatggcaagagattgcattccttctactacccctcccagcctccagccgggacaaggaactggagcaaactcggggctgcagttccgactggactcgcccacctgggcgcgccggctgcccagcctcctgaagcctcggggctgggccctgcggtgatgggcgtgctggccgtcgcagagccctctgggagttgtagtccgtagcggcgagaggtttgacagcgaccgcgggcttggcgcattcagaactccaactcccgccggcccctgcgacccaggctattgccgcttcctgtttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtctaa

SEQ ID NO: 6333 - DNA, 2225 bp, Homo sapiens
aggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaagattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtt

SEQ ID NO: 6334 - DNA, 541 bp, Homo sapiens
attgccgcttcctgtttggactaggagccccgcggtcgcaaattgcgagaatttgggaagggaatctttatcttctcgtctagttctccgaggttgaaggctcggcctgctcaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatg

SEQ ID NO: 6335 - DNA, 370 bp, Homo sapiens
aaattgcgagaatttgggaagggaatctttatcttctcgtctagttctccgaggttgaaggctcggcctgctcagagaaggaaactgaggtccaccgagttggagaaacctactcaacaccaggtaaccatttaatggcaaactcgaccaacacctaattgtcatgactcccaggcagtgtcttatccattgccgtgctctgtagatgagcacactataagttgactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaag

SEQ ID NO: 6336 - DNA, 468 bp, Homo sapiens
gctattgccgcttcctgtttggactaggagccccgcggtcgcaaattgcgagaatttgggaagggaatctttatcttctcgtctagttctccgaggttgaaggctcggcctgctcagagaaggaaactgaggtccaccgagttggagaaacctactcaacaccagtaggactaagctaatgagagctttgacttgcttaaacgttgggcaggaaagcagaagagaaaagggaagtggaaatcaaaacaacagagaaaagaaaatgcacatatttgggaaatagaacatgttactaacatctgtgtcacataataatcagtggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaag

SEQ ID NO: 6337 - DNA, 1756 bp, Homo sapiens
aaatttgtttaactgcgtagattaaatggcaatatattttctataatgaaacttgttgaaatgagagggaatcagctatttacaatcatggcataactacctagggctctgttgtcagcttggtattataatggaaaacaattggatatgtcagagacttagtctattacatttccatggctatttgcattttaacatggagaatccggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgct

SEQ ID NO: 6338 - DNA, 508 bp, Homo sapiens
gcaaattgcgagaatttgggaagggaatctttatcttctcgtctagttctccgaggttgaaggctcggcctgctcagagaaggaaactgaggtccaccgagttggagaaacctactcaacaccagagtttcctgaataagtttttcccaagttctgtgttattctttttgatgaaaggatactggcttccctacaatcatcttttcaacttctaaaatgtttaattttttaaattgagtaggactaagctaatgagagctttgacttgcttaaacgttgggcaggaaagcagaagagaaaagggaagtggaaatcaaaacaacagagaaaagaaaatgcacatatttgggaaatagaacatgttactaacatctgtgtcacataataatcagtggactaacttcttcagtgcttagagtgtgagaaaaatggcaaatatgaatagtgattctaggcatcttggcacctctgaggtagatcatgaaagagatcctggacctatgaatat

SEQ ID NO: 6339 - DNA, 571 bp, Homo sapiens
cccgcggtcgcaaattgcgagaatttgggaagggaatctttatcttctcgtctagttctccgaggttgaaggctcggcctgctcagagaaggaaactgaggtccaccgagttggagaaacctactcaacaccagagtttcctgaataagtttttcccaagttctgtgttattctttttgatgaaaggatactggcttccctacaatcatcttttcaacttctaaaatgtttaattttttaaattgaggactaacttcttcagtgcttagagtgtgagaaaaatggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgt

SEQ ID NO: 6340 - DNA, 2673 bp, Homo sapiens
aagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaaattctaaattctgtgataaataattgaccactgtgacaacagaatgtaagtcattaaagtgcattccattacagtaagttggcaggagttcaaacagttctctgtaaatttgtttaactgcgtagattaaatggcaatatattttctataatgaaacttgttgaaatgagagggaatcagctatttacaatcatggcataactacctaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcagaattttttagacaacttccctagcagtgacaccctgtccttcattgcaaggatattcctgctgttccagatgatgactgtatacccactcttaggctacctggctcgtgtccagcttttgggccatatcttcggtgacatttatcctagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtt

SEQ ID NO: 6341 - DNA, 4032 bp, Homo sapiens
atggcaaatatgaatagtgattctaggcatcttggcacctctgaggtagatcatgaaagagatcctggacctatgaatatccagtttgagccatcggatctaagatccaaaaggcctttctgtatagagcccacaaacatcgtgaatgtgaatcatgtcattcagagggttagtgaccatgcctctgccatgaacaagagaattcattactacagccggctcaccactcctgcagacaaggcactgattgccccagaccatgtagttccagctccagaagagtgctatgtgtatagtccattgggctctgcttataaacttcaaagttacactgaaggatacggtaaaaacaccagtttagtaaccatttttatgatttggaataccatgatgggaacatctatactaagcattccttggggcataaaacaggctggatttactactggaatgtgtgtcatcatactgatgggccttttaacactttattgctgctacagagtagtgaaatcacggactatgatgttttcgttggataccactagctgggaatatccagatgtctgcagacattatttcggctcctttgggcagtggtcgagtctccttttctccttggtgtctctcattggagcaatgatagtttattgggtgcttatgtcaaattttctttttaatactggaaagtttatttttaattttattcatcacattaatgacacagacactatactgagtaccaataatagcaaccctgtgatttgtccaagtgccgggagtggaggccatcctgacaacagctctatgattttctatgccaatgacacaggagcccaacagtttgaaaagtggtgggataagtccaggacagtccccttttatcttgtagggctcctcctcccactgctcaatttcaagtctccttcatttttttcaaaatttaatatcctaggcacagtgtctgtcctttatttgattttccttgtcacctttaaggctgttcgcttgggatttcatttggaatttcattggtttataccaacagaattttttgtaccagagataagatttcagtttccacagctgactggagtgcttacccttgctttttttattcataattgtatcatcacactcttgaagaacaacaagaaacaagaaaacaatgtgagggacttgtgcattgcttatatgctggtgacattaacttatctctatattggagtcctggtttttgcttcatttccttcaccaccattatccaaagattgtattgagcaggtaaggcaccgtgtaccctctctgtgtgattgtgtacactttcatgtatttatagtaggtagggtgatacagtggcaagatataacatcagataggcctgggttttaataccatctctgctatctactccaagtatgggaatttaggcaccttcccttttctttctgagctttatttttcttttccattaaatagtataataagtacccccatttgatttttagatggactctgagataatgtactacatgccaggcaccttgtggtactcaaataaatgtctactattatgtacatatatttctctttttgtggggaactggtacaagtagttctcatgtagttataaaaccacagagaatacattgaaggaactccctatttttaaaagcctgtatcaggaatgccctggataaactagagtctttgtttatcagactctaatgattaatcagactctcattcttatattgagtgacaggcagcaaaacaaaaaaagagtatttggctgttaaaaaaagagagagagatgtcctatgagtcaccagagggttaaaaaaaaaaaaaaagagagacagagtaaaagaaaaaaatattttaataaaagattgccataactaatattttctttgatttaacccatcaaaaacttagcaatagtatagtctttagttataagtgactgaagagtttctcacaaaaaacaacatttcacaagtgactttctggtcagaagaaattcctcttatagagtacaatggaatatactaatgtgatttattacagctgaattataatggttatttcagcaaaataatgttaatagtgttctcatctttataagagaaataagtttgaattactgctattatggcagcttggaaatgttcttattttcttgatttccttgactccagaagttctttggcagccaaatgtttgctggcaatttccctgatatgaacaaactcatacaaagcctactcccttgggaataggaatatttgtggtatttgtatttgaaagaaaagataaaaattctaagtaattaacttttttttaagataccaaaccaaaatggagaaaagggtcatgaaaggaagtagagataaatccttttaaatttagtgatagactaaacaatgatgtagtaggtgatagacatactctcaccttattctgtcatctttacttcaaaagtgcttacagtgcttcagaggaggaaagcagcagagccagagagggtaaaataacactgaattaaattagctctttacatctttaaagtggactggtattttccttgaaccacataaagcaatgctttctcgatctatctgtggtgaaggacaaaattgtctttgctgttgctttaatgttaaataaattgcaggctgatacttttgtaaaatagaataaaattgtggcaatgtcagattcctgtaaaagtttctgaacactttcggtttctatacttacctcattgaaaaaatacttaacaagtagttgtggatgggcactagtccacaaaccacaatcggagtagcacctgtgttcaaaataagcagaagacattccattttatgaatgtgtgtactgaatttgatttttaacatgacctcattatctttcttggattagaattttttagacaacttccctagcagtgacaccctgtccttcattgcaaggatattcctgctgttccagatgatgactgtatacccactcttaggctacctggctcgtgtccagcttttgggccatatcttcggtgacatttatcctaggtaagggctcttctcttgaccagcaggatgtgccaagcaacaaatgactgtgcaagcagcattttccatgtgctgattcttaatctaattattgtgggagctggagtgatcatggcctgtttctacccaaacataggagggatcataagatattcaggagcagcatgtggactggcctttgtattcatatacccatctctcatctatataatttccctccaccaagaagagcgtctgacatggcctaaattaatcttccacgttttcatcatcattttgggcgtggctaacctgattgttcagttttttatgtgaaatacctcaactgtttttttcaagagctctcatgatattttgagccttgacaacagttctatataaattcacttgtaaatgctgctgttgtgtaattctaaatattttctaagataatttgaaagcaagggaaatagtggccccttaatgagtatttttttattggggtggggaaaggggcaaaaagaatgatcttagtgtctttacctttctcatattaactcacctctttattctgtggtcttttctgaatagaaatgtatgccctaggaagaaatcatgctgggttttgcttttagagataaaaggtggtggatttattttgcctgcagtaaagattctcagggtgtcagagcagcatattgtcaaatcctgcttctgttttatgtttcagtgtattcactttcattttcttacttactagaccatttctgcagtttgcccaaacctctactgtttgggacagtaagccaaatacctcatttttaaaaagaagttttcatggcatcagtgttaataaagtacatttttaactgagtcttaatctctatttgaagaaaaagtagagacaaaagtaatgtcaatgtaatccccaggatcatgaaatgtatacaaaataaataaagtaggagagtttgttgctgtc

SEQ ID NO: 6342 - DNA, 2760 bp, Homo sapiens
acgtgtgcgggagggaagcaggaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggatagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtggatg

SEQ ID NO: 6343 - DNA, 2781 bp, Homo sapiens
acgtgtgcgggagggaagcaggaagtgactgcgggagtggagccggcgagagagtggcagcgggggctgatggaagtgcagtgggggctggagagggcaccctactgtatccagcatgctccaaggccacagctctgtgttccaggccttgctggggaccttcttcacctgggggatgacagcagctggggcagctctcgtgttcgtattctctagtggacagaggcggatcttagatggaagtcttggctttgctgcaggggtcatgttggcagcttcctattggtctcttctggccccagcagttgagatggccacgtcctctgggggcttcggtgcctttgccttcttccctgtggctgttggcttcacccttggagcggcttttgtctacttggctgacctcctgatgcctcacttgggtgcagcagaagacccccagacgaccctggcactgaacttcggctctacgttgatgaagaagaagtctgatcctgagggtcccgcgctgctcttccctgagagtgaactttccatccggataggtagagctgggcttctttcagacaagagtgagaatggtgaggcatatcagagaaagaaggcggcagccactggccttccagagggtcctgctgtccctgtgccttctcgagggaatctggcacagcccggcggcagcagctggaggaggatcgcactgctcatcttggccatcactatacacaacgttccagagggtctcgctgttggagttggatttggggctatagaaaagacggcatctgctacctttgagagtgccaggaatttggccattggaatcgggatccagaatttccccgagggcctggctgtcagccttcccttgcgaggggcaggcttctccacctggagagctttctggtatgggcagctgagcggcatggtggagcccctggccggggtctttggtgcctttgccgtggtgctggctgagcccatcctgccctacgctctggcctttgctgccggtgccatggtctacgtggtcatggacgacatcatccccgaagcccagatcagtggtaatgggaaactggcatcctgggcctccatcctgggatttgtagtgatgatgtcactggacgttggcctgggctagggctgagacgcttcggaccccgggaaaggccatacgaagaaacagcagtggttggcttctatgggacaacaagcttctttcttcacattaaaacttttttccttcctctcttcttcatctcattatcctgattgactctgattataatagaaccatttttactttgctttgagggagatttttgatttaatggggaattttaaggtgtcatggaaatacagattctttgttttggccactgaatggactctctcttcagtgggattatcaaggaacttcagatcagggaaatctccacttcgggaccttctatctgcctcccaactcctcaaggtcacctatagaagcgagctaccaaaagacgtctcctaagcattttggtggcctagtgactcagggcagagtggccagcacacctctcatccgcccctcctgctccatcactgctgagcctctccccatctagaatgttggaactggagcatcataaagatagcaagctaccttccaaggccgagccagcccagagaggagcatgtcttcctttacctccccctaaggagatactacatgggagggggacacagaaaaagggaaggaaattggctagtctggctttttttttttttttttttaaaggcaaagattgacattattgaaggaaaggggatgaggacaactgtgaactcacagtgagccctgtggaaagaagagacagacagagtgtgggtttgttcggaggcctctgctgtcaatggattccaggagcaaggccatttgtcgcgctttccaaatttcttaggcatttattttgataagtttatagccatcatgtttctaagagacttggagacaccagcaaactgctagaactcaaactcttcaattactcaaagaaggagccatttcagttaactcaagtgaatgaaagagttttggaatctgctgtgggtccttccctgttgaccatttggtaacttataatctgacaaaaactcttgagctgcaacaggccttgccagagggctcaggatgggaaaggaagaaggggataggaaaagaagaggtaattttacatttcccctttaaagtaaattttagccaactcatcattctgaaatgtccctataaagaatgagtcgaactagaccagaagccagcctactccttcttacatagcttctccaacaggggtagcaatgacctgtccacttcaaacacagataaggcctgccatcctcattggttaaaggcacacgtgagactttcagtgggctctgctgagaaggaaggcagcccaggagtcaggtatgcaggcattgcattgtcagtgtctgctctcagagtttacacattcaattgcttccaagggtgaatctcctgctctgtgaatgctatcagaccccaaaggccaaccttgggctgggtctatgtacgttcttccgaagcactgatgatcaaaattgaagacacattcagaggtttgattggttgagattaactggtgtggtggttggtgtatgtatgttttatttttatgtctttgtatgtagttctacataatgcaaattgtgctttctgatggacaagacctcataactgtgattaatatcaataaaaaggggatgttgtggatg

SEQ ID NO: 6344 - DNA, 2031 bp, Homo sapiens
agtgaaccattaactcctctcttatgtgagccttcacacactggccccacccctgaccccgccccaaggcaggtgggctaggagggggtgcatgtccatctcagccttctatgtgacgtggcctccgatccacctggacacctggaggctaagcctggattcccccttccctgactcaggaactgcttaacgtctacagcaaggcctaataggggacctgagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctgggggccctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccaagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaa

SEQ ID NO: 6345 - DNA, 569 bp, Homo sapiens
ggaaccaagaaggttgtgtcccccttcctctgggtgtccttgtctcctgctatcagggcttcccctttcttggtcatcgatccctagagctctggctctttctcttcttgggggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctacc

SEQ ID NO: 6346 - DNA, 613 bp, Homo sapiens
ctgcctgcccccccagctggaaccaagaaggttgtgtcccccttcctctgggtgtccttgtctcctgctatcagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgag

SEQ ID NO: 6347 - DNA, 559 bp, Homo sapiens
ctgcctgcccccccagctggaaccaagaaggttgtgtcccccttcctctgggtgtccttgtctcctgctatcaggaactgcttaacgtctacagcaaggcctaataggggacctgagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaa

SEQ ID NO: 6348 - DNA, 588 bp, Homo sapiens
atgtgacgtggcctccgatccacctggacacctggaggctaagcctggattcccccttccctgactcaggaactgcttaacgtctacagcaaggcctaataggggacctgaggtgacagctcttatgttgccagtagggggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccct

SEQ ID NO: 6349 - DNA, 1968 bp, Homo sapiens
agctggaaccaagaaggttgtgtcccccttcctctgggtgtccttgtctcctgctatcagggcttcccctttcttggtcatcgatccctagagctctggctctttctcttcttggggaactgcttaacgtctacagcaaggcctaataggggacctgagggcacagtcctcaggatgtttcggggagaataggagccagaacctgagcccctaagctattcccctcaccaatgatggggtccccagtgagtcatctgctggccggcttctgtgtgtgggtcgtcttgggctgggtagggggctcagtccccaacctgggccctgctgagcaggagcagaaccattacctggcccagctgtttggcctgtacggcgagaatgggacgctgactgcagggggcttggcgcggcttctccacagcctggggctaggccgagttcaggggcttcgcctgggacagcatgggcctctgactggacgggctgcatccccagctgcagacaattccacacacaggccacagaaccctgagctgagtgtggatgtctgggcagggatgcctctgggtccctcagggtggggtgacctggaagagtcaaaggcccctcacctaccccgtgggccagccccctcgggcctggacctccttcacaggcttctgttgctggaccactcattggctgaccacctgaatgaggattgtctgaacggctcccagctgctggtcaattttggcttgagccccgctgctcctctgacccctcgtcagtttgctctgctgtgcccagccctgctttatcagatcgacagccgcgtctgcatcggcgctccggcccctgcacccccaggggatctactatctgccctgcttcagagtgccctggcagtcctgttgctcagcctcccttctcccctatccctgctgctgctgcggctcctgggacctcgtctactacggcccttgctgggcttcctgggggccctggcggtgggcactctttgtggggatgcactgctacatctgctaccgcatgcacaagaagggcggcacgcaggacctggcggactaccagagaaggacctgggcccggggctgtcagtgctcggaggcctcttcctgctctttgtgctggagaacatgctggggcttttgcggcaccgagggctcaggccaagatgctgcaggcgaaaacgaaggaatctcgaaacacgcaacttggatccggagaatggcagtgggatggcccttcagcccctacaggcagctccagagccaggggctcagggccagagggagaagaacagccagcacccaccagctctggcccctcctgggcaccaaggccacagtcatgggcaccagggtggcactgatatcacgtggatggtcctcctgggagatggtctacacaacctcactgatgggctggccataggtgctgccttctctgatggcttctccagcggcctcagtaccaccttagcggtcttctgccatgagctgccccacgaactgggtgactttgccatgctgctccagtcagggctgtcctttcggcggctgctgctgctgagcctcgtgtctggagccctgggattggggggtgcagtcctgggggtggggctcagcctgggccctgtccccctcactccctgggtgtttggggtcactgctggggtcttcctctatgtggcccttgtggacatgctaccagccctgcttcgtcctccggagcccctgcctacgccccatgtgctcctgcaggggctggggctgctgctggggggcggcctcatgcttgccataaccctgctggaggagcggctactgcccgtgaccactgagggctgatggggccagtggaaaggggtcgggttgcccttccttccccccaaccacaggaatggaggcgggacacagggccagtaggagcaataggattttaataaacagaacccatcccaaa

SEQ ID NO: 6350 - DNA, 2065 bp, Homo sapiens
atgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgcatacctt

SEQ ID NO: 6351 - DNA, 5322 bp, Homo sapiens
gagtggaccttgtacgccgcaagcgtagcagggtgtcagacgcgccggtttctgcgacgcagttagcgcagtctgctttggtgaatacacgatttggtgcagccggggtttggtaccgagcggagaggagatgcacacggcactcgagtgtgaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttttcattgtcaacagtggtgtgtcattttatgtatgttcctaatgcttatggaactcctccaaaataaagttactcaaagagagcaaata

SEQ ID NO: 6352 - DNA, 5432 bp, Homo sapiens
agttgatcactctgaagctttttggctaaagcgtttgggtttagagcttccattactcattcgccttgcccaaggcctcagcaaccgacgttcgaaagccaggagaaaaggcgaatgataaagggcgctccacgcatgcgttaagaagccgccccaactcccccgcggcgttctttcttggaacaaaactagcgcggagccacggaactccgcagtttgcgtagacttgaatttcctattcctcggacgatccatgtggaatccgaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcattcccataatcatttaaattcagaaaatcaaactgtgaccagtgtatccacaaaaagaaaccataaatgtgatccagagaaagagacagttgaagtgtctgtaaaatctgatgataaacatatgcatgaccataatcaccgcctacgtcatcaccatcgtttgcatcatcatcttgatcataacaacactcaccattttcataatgattccattactcccagtgagcgtggggagcctagcaatgaaccttcaacagagaccaataaaacccaggaacaatctgatgttaaactaccgaaaggaaagaggaagaaaaaagggaggaaaagtaatgaaaattctgaggttattacaccaggttttccccctaaccatgatcagggtgaacagtatgagcataatcgggtccacaaacctgatcgtgtacataacccaggtcattctcatgtacatcttccagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgatagggatcaacttgacacaactttgaaactgcataaagtagacataggaactagaggaaagctcaggctgcattagagtatgaatttagcattgggaaaagcccttattcttgaatctagagttactatttttgtatatatttgcatagtgtttaaacctgcagcctaaactactgaaatttgtgattgtatgtttgtgtgagcttcagtttaatgaaagattcataatggttctttgtattattataatacttggtgttggggtgttctttctgttttgttttttactttaattttgttttgattttttttttttttttttggcgggggtaggtgagggtttggagcatgtggtctttttaaaaaattgtaaccctctagaaaatatcaaagaaatgaaccagacgtggtttaaatagttgattttcctattttaacagtaccaactagttaattgggaaatgtaagttctgaatgttcacattgctttaccagtttggcactggaaccaagagcacatgtcgtggctggctacaaggttgtaaagcagaaaatcgaagtttaccatgtctgtaatgtgtacatgaagtgtcaatttagaacagttactaggataaactccattattgccatggctgtcatggtacccaagtgacttggaagatgcatttaaattactcagctgaaatcacttgatcatcttgtgccaagatatgctgttggtgcctgatagggattagtcttttaggtgccctgttctcctaccataattgtgaatgatttgtgagaagtgcaagccatgtttatcctgaatttttacttaataatttgtattactagtcatatgcatgtagctttctgtttacatcctatgccacatggtcttcatttatgccaggtaaactgtatttgaactatgtgcagctagctttgttttaatctgcttggcaaccagtgtagctgctgtaacaatctatcttattgttcaaatatataagagccaaactcttttccattccatctaaaatgttttcatttagtactcttctttcctcctactctatgaacttcaaaacaaaaacaaaactttgagagcagcacatgcatccaggtatttatagattattgccagtgtcttttctgtatgctataagcaagggagcttaggtgttatttctttaatttatgcttgaatctgaaaaattatttctgacttactccatggcctccttataataagtagaagttttatatataattaattttcagcattgggcactgaattaggacagtcctcatctcattgcttggcccttcaagcaacctagctaaaaggtgctgatattttatttagtactgccaacttcaagtgatttagatatctatctatctagatttctgaaccaagatatatttatagttcacttttgggtttttatacccacggtaggattctgcattccagcattaaatctgcttcattttagaacctttataaaagcaatagctggaatatactcccagttttaaaataaatgcctgattgatttaaagcaagtaggttatgctgaagtatataaagaagttttatattctctcaaaaatggtattatctttctttatttgctagattcttacaaatcttttaagagggctgtaacagttgctgctagtattagggttccacatcattctaatgtatagtttcaagtcttaatagacaatctgaattccactacatttcttttggctccaacattccttttagcttgaccagtctaatttaaaatgtgtttgttggaggtcattaacgttacttgtacaatgctgtcactgtgtgacatccatatgaattttggtatatatcaatcaatcaatcaatcacattgcattcaatcaatcagctgtgattgattgattatgcttagaaatactatagtaactagatgcagtgtgaattttttccattaacaaacaaacaagtcagtggcttaaatgtgattatggtcctgcaaggtgattcttgctaaaatatctaaacttttgttttgttttaactgaatcattttttaacttaaaaagctggaaaatatcaaatgctgttttttttttttcattgtcaacagtggtgtgtcattttatgtatgttcctaatgcttatggaactcctccaaaataaagttactcaaagagagcaaata

SEQ ID NO: 6353 - DNA, 337 bp, Homo sapiens
cttgtacgccgcaagcgtagcagggtgtcagacgcgccggtttctgcgacgcagttagcgcagtctgctttggtgaatacacgatttggtgcagccggggtttggtaccgagcggagaggagatgcacacggcactcgagtgtgagagatcctctttgtgctgtcgatggaaaagattgttaacatctactggaatgcttgggaaactctgaaaaatagaaatgaaggtacatatgcacacaaaattttgcctcatttgtttgctgacatttatttttcatcattgcaaccattgccatgaagaacatgaccatggccctgaagcgcttcacagaca

SEQ ID NO: 6354 - DNA, 563 bp, Homo sapiens
gcagtcggcggcggccagccgaagcagagcgcgtggtgggcagagtgttgggcgccgcggctcctcgtgtgcggtctgggctgctgcgggccgcgggatcgggagccggcggcatccacttcgcgtgcggagcctcgcgcccccctcaccttcctgtggaggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacataaccaccagcatt

SEQ ID NO: 6355 - DNA, 593 bp, Homo sapiens
attagatggggggctgcggcttggagaacactcacagttctgagttcagctgtggacggaataatgaagggcagctgcagaaggaggtagagctgcagattcagagcccctggacctgagaggcttcaataattgttacctgagttggattgaattgaaataaagaagtaaagatcctatatcatctactgaaatctttaaagggaaaaatagaaatgaaggtacatatgcacacaaaattttgcctcatttgtttgctgacatttatttttcatcattgcaaccattgccatgaagaacatgaccatggccctgaagcgcttcacagacagcatcgtggaatgacagaattggagccaagcaaattttcaaagcaagctgctgaaaatgaaaaaaaatactatattgaaaaactttttgagcgttatggtgaaaatggaagattatccttttttggtttggagaaacttttaacaaacttgggccttggagagagaaaagtagttgagattaatcatgaggatcttggccacgatcatgtttctcatttagatattttggcagttcaagagggaaagcattttcactcacat

SEQ ID NO: 6356 - DNA, 2219 bp, Homo sapiens
agttagcgcagtctgctttggtgaatacacgatttggtgcagccggggtttggtaccgagcggagaggagatgcacacggcactcgagtgtgaggaaaaatagaaatgaagaacgtaatggtcatgatcctggtcgtggacaccaagatcttgatcctgataatgaaggtgaacttcgacatactagaaagagagaagcaccacatgttaaaaataatgcaataatttctttgagaaaagatctaaatgaagatgaccatcatcatgaatgtttgaacgtcactcagttattaaaatactatggtcatggtgccaactctcccatctcaactgatttatttacatacctttgccctgcattgttatatcaaatcgacagcagactttgtattgagcattttgacaaacttttagttgaagatataaataaggataaaaacctggttcctgaagatgaggcaaatataggggcatcagcctggatttgtggtatcatttctatcactgtcattagcctgctttccttgctaggcgtgatcttggttcctatcattaaccaaggatgcttcaaattccttcttacattccttgttgcattagctgtaggaacaatgagtggagacgcccttcttcatctactgccccattctcagggtggacatgatcacagtcaccaacatgcacatgggcatggacattctcatggacatgaatctaacaagtttttggaagaatatgatgctgtattgaaaggacttgttgctctaggaggcatttacttgctatttatcattgaacactgcattagaatgtttaagcactacaaacaacaaagaggaaaacagaaatggtttatgaaacagaacacagaagaatcaactattggaagaaagctttcagatcacaagttaaacaatacaccagattctgactggcttcaactcaagcctcttgccggaactgatgactcggttgtttctgaagatcgacttaatgaaactgaactgacagatttagaaggccaacaagaatcccctcctaaaaattacctttgtatagaagaggagaaaatcatagaccattctcacagtgatggattacataccattcatgagcatgatctccatgctgctgcacataaccaccacggcgagaacaaaactgtgctgaggaagcataatcaccagtggcaccacaagcattctcatcattcccatggcccctgtcattctggatccgatctgaaagaaacaggaatagctaatatagcctggatggtgatcatgggggatggcatccacaacttcagtgatgggctcgcaattggtgcagctttcagtgctggattgacaggaggaatcagtacttctatagccgtcttctgtcatgaactgccacatgaattaggagattttgcagttcttcttaaagcaggcatgactgtaaagcaagcaattgtatacaacctcctctctgccatgatggcttacataggcatgctcataggcacagctgttggtcagtatgccaataacatcacactttggatctttgcagtcactgcaggcatgttcctctatgtagccttggtggatatgcttccagaaatgttgcatggtgatggtgacaatgaagaacatggcttttgtcctgtggggcaattcatccttcagaatttaggattgctctttggatttgccattatgctggtgattgccctctatgaagataaaattgtgtttgacatccagttttgacctttcccagtaatcactgttgattacgagaatgttaccatgcagctttgcatctgttccttgtactgtatgcacattgctcaaaggaaagtcagtggcttgcactacttacaagtttcatagatttgagcctaaccacaagaggctggtgcttagtactgttttccctgcacgtaggggtcttttaaaaatataaagcttgtgataaagagaggagaatatgggactccatgaaccagtgttgatatgtttgattaagacttttcacaaaataatcatataaaacactagtctctttattagtagaaacttctgtggctatgcagaaatagagatcgaaccaaaaaaaatcatttaaactttaaaaatattttaaatggactttggggagacattttttgtgtgttttaagaatgaattgtagtgctctttaattcagctacatatattcatgtggtgata

SEQ ID NO: 6357 - DNA, 2808 bp, Homo sapiens
ttgttaccttcagagcagctctctccatagcaactgaaaacttttctgggctgaaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaatatggtg

SEQ ID NO: 6358 - DNA, 2725 bp, Homo sapiens
gtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaata

SEQ ID NO: 6359 - DNA, 2639 bp, Homo sapiens
aaataatcctctctagctcccagtgcacagtcaaagaattttaaaaacagggaactttgtaactgtgaaatactctccaggatttaaaaggctgtggagctccagataaagaatcgtttatctttcttctgaagaaattcctttggttacaagtttaccccataaacggcaacacactcacctccatccaagacagactcaaggtggaggaagcgtggaaatgtgcttccggacaaagctctcagtatcctgggtgccattgtttcttctactcagccgtgttttttctactgagacagacaaaccctcagcccaggatagcagaagccgtgggagttcaggccaaccggcagacctgctacaggttctctctgctggtgaccacccaccccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttttaata

SEQ ID NO: 6360 - DNA, 2483 bp, Homo sapiens
aagacagactcaaggtggaggaagcgtggaaatgtgcttccggacaaagctctcagtatcctgggtgccattgtttcttctactcagccgtgttttttctactgagacagacaaaccctcagcccagcccacaaccactcaagaagcctcatcaaaacattgttggagaaaactgggtgcccacggaggagaaacggaatgcaaggagattgcaatctgtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttcaaaaatgcatttatatagtcttactttgtttctttcattgcactctataatgatttttaaattaagaattttttatcttaggcaaagtgtgtctctttcaattcattaacttattaattttataatgcagttttatttttggaaacatataaatatcagactgtccttaattgaaattttgtctttggtttccaacaccatgatgaagctcttgctttttaaaaagtagttagtaaattctgcatgaattttagtaaactttaaaaaatagattttttccctaagaaagaatgtttgtagaatttaaagtggacagatgcctgttggagtaaaatcaactgcaactttttgatgttaatttttttccctgtgcaattataaactataagcaagttaagtgacaagcaaatgtaataaagactagttt

SEQ ID NO: 6361 - DNA, 1900 bp, Homo sapiens
actctccaggatttaaaaggctgtggagctccagataaagaatcgtttatctttcttctgaagtgctttgaaccagatgcactattactaatagctggaggaaattttgaagatcagcttagagaagaagtggtccagagagtttctcttctccttctctattacattattcatcaggaagagatctgttcttcaaagctcaacatgagtaataaagagtataaattttacctacacagcctactgagcctcaggcaggatgaagattcctctttcctttcacagaatgagacagaagatatcttggctttcaccaggcagtactttgacacttctcaaagccagtgtatggaaaccaaaacgctgcagaaaaaatctggaatagtgagcagtgaaggtgctaatgaaagtacgcttcctcagttggcagccatgatcattactttgtccctccagggtgtttgtctgggacaaggaaacttgccttccccagactactttacagaatatattttcagttccttgaatcgtacgaataccctccgcctatcagaactagaccaactcctcaacactctctggaccagaagtacttgtatcaaaaatgagaaaatccatcaatttcaaaggaaacaaaacaacataataacccatgatcaggactattctaatttctcttcatccatggaaaaagagtctgaggatggtccagtttcctgggatcagacctgcttctctgctaggcagctggtggagatatttctacagaagggcctctcactcatttctaaggaggactttaagcaaatgagtccagggatcatccagcagctcctcagctgctcctgccacttacccaaggaccaacaagcaaagctgccacctaccactctggagaaatacggctacagcacggtggctgtcacccttctcacactgggctccatgctggggacagcgctggtccttttccatagctgtgaggagaactacaggcttatcttacagctgtttgtgggcttggccgtcgggacactgtctggggacgctctgctccaccttatccctcaggttcttggtttacataagcaggaagccccagaatttgggcatttccatgaaagcaaaggtcatatttggaaactgatgggattaattggaggcatccatggatttttcttgatagaaaaatgttttattcttcttgtatcaccaaatgacaagcagggcctgtcattggttaatgggcacgtgggtcattcccaccatcttgcactcaactctgaattaagtgaccaggcaggcagaggcaaatctgcttcaactatccagttgaaaagcccagaagattcacaggcagctgaaatgcctataggcagtatgacagcctccaacagaaaatgtaaagccattagcttgttagcaatcatgattctggttggggacagcctgcataattttgcagatggcctagccataggagcagccttctcatcatcatccgagtcaggagtgaccactacgattgctatcttgtgtcatgaaatcccacatgaaatgggagactttgccgtgctcttaagctctggactttctatgaagactgccatcctgatgaattttataagctccctaactgccttcatgggattatacattggcctttccgtgtcagctgatccatgtgttcaagactggatcttcacagtcactgctgggatgttcttatatttatccttggttgaaatgcttcctgaaatgactcatgttcaaacacaacgaccctggatgatgtttctcctgcaaaactttggattgatcctaggttggctttctctcctgctcttggctatatatgagcaaaatattaaaatataagtgaggatcttcaacatctttc

SEQ ID NO: 6362 - DNA, 1708 bp, Homo sapiens
cagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgatggagttttgctctgttgcccaggctggagtgcaatggtgccatctcagctcactgcaacctctgccgcttgggttgaagcgattatcctgtctaagcctcccgagtaactgagccagccatgtttgttaataaaaatggggacaatactgtatatatatggttatattttagctttttcacttttcagtatctcctgaggcttttctcatgtcattaaatatttttctaatttaaaa

SEQ ID NO: 6363 - DNA, 2137 bp, Homo sapiens
cacacgcccggacggctgggtggaggctgcacctggccgtggtgccgcgctggcgaggggagaggtcaaggcgcggcctgtccgcctggagggtgcgggatgctagagccgcagaagggtgcccagagcgtgggtcgccgcgccgaaggctgagccaggctcccggattccccgcgcggacacggacgcagaacgcagacagtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttg

SEQ ID NO: 6364 - DNA, 4641 bp, Homo sapiens
atatagccgggcatgcgcgcggtgccggggcccggacgcagtgaggggggtcggcgcgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggctttggttttctcagtgtctcactgattaacctggcctctctcctgggagtcctcgtcctgccctgcacagagaaagcgtttttcagccgtgtgctcacttacttcatcgccctgtccattggaacgctgctgtctaacgcgctattccagctcatcccagaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaa

SEQ ID NO: 6365 - DNA, 4641 bp, Homo sapiens
cgcgtgtctacgcggacgcaccggctaagctgcttctgccgccgccggccgcctgggaccttgcggtgaggctgcgcggggccgaggccgcctccgagcgccaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacgtgctttagttctggagacctcttcactgcccacaatttcagcgagcagtcgcggattgggagcagcgagctccaggagttctgccccaccatcctccagcagctggattcccgggcctgcacctcggagaaccaggaaaacgaggagaatgagcagacggaggaggggcggccaagcgctgttgaagtgtggggatacggtctcctctgtgtgaccgtcatctccctctgctccctcctgggggccagcgtggtgcccttcatgaagaagaccttttacaagaggctgctgctctacttcatagctctggcgattggaaccctctactccaacgccctcttccagctcatcccggaggcatttggtttcaaccctctggaagattattatgtctccaagtctgcagtggtgtttgggggcttttatcttttctttttcacagagaagatcttgaagattcttcttaagcagaaaaatgagcatcatcatggacacagccattatgcctctgagtcgcttccctccaagaaggaccaggaggagggggtgatggagaagctgcagaacggggacctggaccacatgattcctcagcactgcagcagtgagctggacggcaaggcgcccatggtggacgagaaggtcattgtgggctcgctctctgtgcaggacctgcaggcttcccagagtgcttgctactggctgaaaggtgtccgctactctgatatcggcactctggcctggatgatcactctgagcgacggcctccataatttcatcgatggcctggccatcggtgcttccttcactgtgtcagttttccaaggcatcagcacctcggtggccatcctctgtgaggagttcccacatgagctaggagactttgtcatcctgctcaacgctgggatgagcatccaacaagctctcttcttcaacttcctttctgcctgctgctgctacctgggtctggcctttggcatcctggccggcagccacttctctgccaactggatttttgcgctagctggaggaatgttcttgtatatttctctggctgatatgttccctgagatgaatgaggtctgtcaagaggatgaaaggaagggcagcatcttgattccatttatcatccagaacctgggcctcctgactggattcaccatcatggtggtcctcaccatgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctgggcatctactttaaaacaaagttgtctgatttttgcaagagaggttaggattttattgttcttatttccctttacagttctgcagttccatcacagtatttttttaaataactcaggtgtatgagaagaaattagaaaagaaaattaacttatgtggactgtaaatgttttatttgtaagattctataaataaagctatattctgtaattgttgagaatcccacgggtgatcatttgcaataaatgtggatgtaatgaaggctgttgaacacaa

SEQ ID NO: 6366 - DNA, 3144 bp, Homo sapiens
ccgcggacctgtcagagatacagaggttgtgggggcgggagacagaaagagagagagatccagagaccgagtcttacgttgacacgcagagagaaagacgcagagacagacaaacaaacagataggagaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 6367 - DNA, 3238 bp, Homo sapiens
agtgtggttttagtttttcctaagaagtggcgtggtttggggctttatatccgggaggagcatatgtacgcaaatcctggggcgtttgcaaacccggatccggggcgtctggccccatgcccggccgggcgtttgagggctactgccacgcagcgtttctggagcctgccggctggtgccctggtggcctttatctctgtccccctttgtcctctttatctcaggctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaaggtaactggaagaaaaaccgatttcaccttcttcatgattcagaatgctggaatgttaactggattcacagccattctactcattaccttgtatgcaggagaaatcgaattggagtaatagaaaatggaagatggtgttgttaataaaggcatttaatagataaaaacatctccaaaaaggattttgaagctgatcctatttagttaaaaagataattttgctttcaactgtaggtccagaaaactaattattggcatcagtctgtgaaatagtccattatttgttgttaaaaatgcttcaaaaggttttcagtgtcagtctgagatgcctggtatataggagcctttgggaaatacctatttttcagtattccatgcatattagatatcaccatgaagcaagagacatgcattctataatcatgtagacactcagactcaggggaaaatacaagttatatcctgaaagcctttaaaactctatggtaggatcaaagattcaaatggtttcagagaggttttatttcaattaatttgttctagtgctttcaagagcaagtacatcaaaatgtagaaggtaaaatgtatgcaacactaatataaattattccaagtctttaaggagccaaagaaaaaaaagatttctcacagctttttgttctgttttgtatttcaattaggaacttgcagtattattttgaaaaccattctaaaataataggagttaggaaataaataaagttttgctagccctgctaagttcaggcttagaggcttatcgctaagtataaacttcaccagattccacgaaaagctggatagctttttttctgacttatgttgtggttgcacccctcacaaatggcagaacagtatgtaaagctggtaacacctcggtttcagtgcaccatgtgtttgctttgtgaaggtgaagaatatgttggtttagagaaagaaattggatgtaattttatgcaatttacttttaaagacaaacataactatttagcagagaatattttaataaatgcaaaacaacagctggactgctgtacatcaaggacagattaactggaaaacatatgttccttatgtgtgatcgagagccattcagaaaagacttcctttgtgttcagcctatacttttccatatggtataccttgaaaaaaattagcacaccatggttatttttctaccttttataaaagacagagcctgtttactcatttagaagatagagaaaattggtctaaaattgaacatcctagattcacactcccaagtcacttaaggtgatttgatggtgaggaaaatgattgacaaagcccaacaatgatctcaggaattacattttccaacagaccaaaaaatgttttcatgtagcagcaatgcagatttggtgaatatttaatatatattttagtatgtatttcactttatgactgacaattaaaaaatattgtttggccaaatagtaaacacccttttgaaacca

SEQ ID NO: 6368 - DNA, 4032 bp, Homo sapiens
acttctaagtttgcggcggagagaataaagcagaaagacaggaagaggaggtggagttctacagctctccaggaggccggggggcccactccgcctatcgctcccctcggctacgctgccacttcaatgccccgcaggtcgcgagctgctgttctttcgaaggcgtcggagaaccaggggcgtcccgcgccacctctgactcggagcagcgccgagcactgacgctcccgcccttgggcaaggacgccagtgcgcccgcgcgcgtccctctgcgcggcagcccgtcgcgggccctcaaggggaagcccaggccaggatggccccgggtcgcgcggtggccgggctcctgttgctggcggccgccggcctcggaggagtggcggaggggccagggctagccttcagcgaggatgtgctgagcgtgttcggcgcgaatctgagcctgtcggcggcgcagctccagcacttgctggagcagatgggagccgcctcccgcgtgggcgtcccggagcctggccagctgcacttcaaccagtgtttaactgctgaagagatcttttcccttcatggcttttcaaatgctacccaaataaccagctccaaattctctgtcatctgtccagcagtcttacagcaattgaactttcacccatgtgaggatcggcccaagcacaaaacaagaccaagtcattcagaagtttggggatatggattcctgtcagtgacgattattaatctggcatctctcctcggattgattttgactccactgataaagaaatcttatttcccaaagattttgaccttttttgtggggctggctattgggactcttttttcaaatgcaattttccaacttattccagaggcatttggatttgatcccaaagtcgacagttatgttgagaaggcagttgctgtgtttggtggattttacctacttttcttttttgaaagaatgctaaagatgttattaaagacatatggtcagaatggtcatacccactttggaaatgataactttggtcctcaagaaaaaactcatcaacctaaagcattacctgccatcaatggtgtgacatgctatgcaaatcctgctgtcacagaagctaatggacatatccattttgataatgtcagtgtggtatctctacaggatggaaaaaaagagccaagttcatgtacctgtttgaaggggcccaaactgtcagaaatagggacgattgcctggatgataacgctctgcgatgccctccacaatttcatcgatggcctggcgattggggcttcctgcaccttgtctctccttcagggactcagtacttccatagcaatcctatgtgaggagtttccccacgagttaggagactttgtgatcctactcaatgcagggatgagcactcgacaagccttgctattcaacttcctttctgcatgttcctgctatgttgggctagcttttggcattttggtgggcaacaatttcgctccaaatattatatttgcacttgctggaggcatgttcctctatatttctctggcagatatgtttccagagatgaatgatatgctgagagaaaagataatcaaatgggctactgatgacatcaaatctcaacttcatttactttggatatatacggcaaggtagtaatttcattatctggagtatttcacctccacatctctgcaataccagcaccttcaacagtgattggttagaggttggcatatgacatagttatgaccattgagacgtgatgctgtgtgtgctgtgaagtttctcaaaaggagtaaggaagatacagcctcttctttctagggactttgtttgtaggtgtgacacctggagcagccattttgctactgttttgtttctaattgtgttccccgccgccctccccgctcgccccgaaaaacgacatgtttgagttctaatccccagtatttcagaatgtgaccttatttggaaatagagtcattgcaaatgtaatttgttaagatgagctcatactggagtagagtgggttcctgatctagtatgactggtattcttattaaaaagagaaatttgaatactagctacaccatgtaaagatgaaggcagagatcgtggtgatgcatctacaatgtcaacaattgccagcaaatcatcagaatctgggagagaggtatggaatgaattctctctcgcagccctaagaaggaaccaatcctgtgcacacctgaatcttggacttccagcctccacaactgtgagacaatacatttttgttatttaagctacccagttgtggcactttattactgcagttctagccgactaatacagctaccttgagaggaaatagcatggggatgaaggtgatgtgctgaagaagcacagcagaaagtggaaagatggtccatgaggacatccttagccactgaattgacaagcctcttccctggagtccctcttccttgggattttttttggtgtgtgtaataatcacttttcctaatggtgcaaaccattgtgagttgctctttgactgctagtaattaaagcaaactaaccaagtcagccctccccagtgttcctttttgcaatctaaattctgatgtccaactcctccctgggccactccctgtccccagatgtctctttgtatatctaaagaagaaaaagaaggataaatcctttttctcccaagagatctccctgcttttgtgaaaagcacaaagaagggcattatctaacttttctcatcattagaagtcaagcctggccgtgactcccgttatgacattttgatggccacattttatgagaaaagcccaaacagacagacctgtctgtaaattctttcatcctttgcattctttctttgactgtaccttagagagtgtttgattattgcaggggagatggaaaagaagcaggttctggcctatgctctagttcctcactttctggagttatcttttgggcctggagtctcttggagtgaggaaaggaagccatttttatactttacttatggtagagttaaacttcgtactcttaggaggctacatgcaatctccaagaggaagagagtgaagaggttaagaattatgccatcaaaatgtgctgctctggcatattgactatttgaattacagatattttaaaaacatcagatatgaagaggtcactctgatcttaattctgtgtcttaacagcaggagatgaaattcccacatgggagatggcctccctgtcacagaaggaataccattctccctatcaatgatgagaaattggaactgagagaattctgtatagaccttgttcaagtaattcttctattttaaacctccccacataatttagctgccttttcaaaactactgtcctttgtgcaaccagtatagaagcgattgactctcactgcatccttgggtcttcttttccctatatgggctcttttcccatatgggctcttatgtcctgtaaaacatgtattaaataaatttgtatgcttttctcccgttaacctgtcttacatcaatttaattcttgggcccaggtaggaccctaagaggacagaggtcgagttttgccacctctgcaagagaaaagagagatgcccagaccaccaggcctgggaaatctttgatttcccaggctttgaagtgggcactgtgtctgaacctggccctctgaaacttcctgttcctggacatcccagctgctaatgtgagttgcccttgcactggctcagggctgggacattaaaggaatttcccttttgttgacataacagtaggatggctatagctaacaataatatattatttagtttcaagtagctagaaggaacatatgaatgttcccaacacaaagaaatgacaactatttgagatgatggatatgctaataaccttaatctgattcctatacattatatgcatcacatatacatacattatatgtataacatcactatgtaccccataaatatgtgcaattattgtcaattaaacaaataaatttaaacaaacatt

SEQ ID NO: 6369 - DNA, 3560 bp, Homo sapiens
gaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggtgaggttaaaacctgagtaatggaaaagcttttagagtagaaacacatttacgttgcagttagctatagacatcccattgtgttatcttttaaaaggcccttgacattttgcgttttaatatttctcttaaccctattctcagggaagatggaatttagttttaaggaaaagaggagaacttcatactcacaatgaaatagtgattatgaaaatacagtgttctgtaattaagctatgtctctttcttcttagtttagaggctctgctactttatccattgatttttaacatggttcccaccatgtaagactggtgctttagcatctatgccacatgcgttgatggaaggtcatagcacccactcacttagatgctaaaggtgattctagttaatctgggattagggtcaggaaaatgatagcaagacacattgaaagctctctttatactcaaaagagatatccattgaaaagggatgtctagagggatttaaacagctcctttggcacgtgcctctctgaatccagcctgccattccatcaaatggagcaggagaggtgggaggagcttctaaagaggtgactggtattttgtagcattccttgtcaagttctcctttgcagaatacctgtctccacattcctagagaggagccaagttctagtagtttcagttctaggctttccttcaagaacagtcagatcacaaagtgtctttggaaattaagggatattaaattttaagtgatttttggatggttattgatatctttgtagtagctttttttaaaagactaccaaaatgtatggttgtcctttttttttgttttttttttttttaattatttctcttagcagatcagcaatccctctagggacctaaatactaggtcagctttggcgacactgtgtcttctcacataaccacctgtagcaagatggatcataaatgagaagtgtttgcctattgatttaaagcttattggaatcatgtctcttgtctcttcgtcttttctttgcttttcttctaacttttccctctagcctctcctcgccacaatttgctgcttactgctggtgttaatatttgtgtgggatgaattcttatcaggacaaccacttctcgaactgtaataatgaagataataatatctttattctttatcccccttcaaagaaattacctttgtgtcaaatgccgctttgttgagcccttaaaataccacctcctcatgtgtaaattgacacaatcactaatctggtaatttaaacaattgagatagcaaaagtgtttaacagactaggataatttttttttcatatttgccaaaatttttgtaaaccctgtcttgtcaaataagtgtataatattgtattattaatttatttttactttctataccatttcaaaacacattacactaagggggaaccaagactagtttcttcagggcagtggacgtagtagtttgtaaaaacgttttctatgacgcataagctagcatgcctatgatttatttccttcatgaatttgtcactggatcagcagctgtggaaataaagcttgtgagccctctgctggccacagtgaggaaagtagcacaaataggatacagttgtatgtagtcattggcaacaattgcatacaattttactaccaagagaaggtatagtatggaaagtccaaatgacttccttgattggatgttaacagctgactggtgtgagacttgaggtttcatctagtccttcaaaactatatggttgcctagattctctctggaaactgactttgtcaaataaatagcagattgtagtgtc

SEQ ID NO: 6370 - DNA, 2377 bp, Homo sapiens
ccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctggggggcggatcaccttcggggccgcctcttggagacaggggcgcctagggaacgaacaggttcgcttgagtcacttacccgccgccgcctaagacattgtgccaccctcaatccgacaatcgaagaaatcgatcattcgcacattttccccattgacttttcccatctctgttaacccacgagaatctaatgactggcatctgagaacccagagcctgggaccttagattgctgtaagctttctctggtgctaatatcagcaaaaagggtctgttgccgggtacgttcaagaggaaggtgcctcgtgaacacatctgctggtgggaaggcctaaagaactggaaagcccactctcttggaaccaccacacctgtttaaagaacctaagcaccatttaaagccactggaaatttgttgtctagtggttgtgggtgaataaaggagggcagaatggatgatttcatctccattagcctgctgtctctggctatgttggtgggatgttacgtggccggaatcattcccttggctgttaatttctcagaggaacgactgaagctggtgactgttttgggtgctggccttctctgtggaactgctctggcagtcatcgtgcctgaaggagtacatgccctttatgaagatattcttgagggaaaacaccaccaagcaagtgaaacacataatgtgattgcatcagacaaagcagcagaaaaatcagttgtccatgaacatgagcacagccacgaccacacacagctgcatgcctatattggtgtttccctcgttctgggcttcgttttcatgttgctggtggaccagattggtaactcccatgtgcattctactgacgatccagaagcagcaaggtctagcaattccaaaatcaccaccacgctgggtctggttgtccatgctgcagctgatggtgttgctttgggagcagcagcatctacttcacagaccagtgtccagttaattgtgtttgtggcaatcatgctacataaggcaccagctgcttttggactggtttccttcttgatgcatgctggcttagagcggaatcgaatcagaaagcacttgctggtctttgcattggcagcaccagttatgtccatggtgacatacttaggactgagtaagagcagtaaagaagccctttcagaggtgaacgccacgggagtggccatgcttttctctgccgggacatttctttatgttgccacagtacatgtcctccctgaggtgggcggaatagggcacagccacaagcccgatgccacgggagggagaggcctcagccgcctggaagtggcagccctggttctgggttgcctcatccctctcatcctgtcagtaggacaccagcattaaatgttcaaggtccagccttggtccagggccgtttgccatccagtgagaacagccggcacgtgacagctactcacttcctcagtctcttgtctcaccttgcgcatctctacatgtattcctagagtccagaggggaggattagaactaagaggacacaccagcatcggagtgtattaagcccctgaaacacatggtagctagggactgaacacaggaaccgtatgacagcagcacaaacccccaaaggatgttcctgccttgtgggcccctgagccccttgggagactgagaatcatgaccagattcatccagaactgctgcagtgttaagtgaaaatcctctgtagttgttctgcagaggaaccttccttccattagaaaatttctgctcaatacagaatggtccacatcacccaaagtgcactgttggagatgctgtgaaattaaaacctctttgtacctgagacatctagattcacctcaggaggcctgaaggaaatgtgtaacttgtgggaaagaactagacaaccatttaggaattctctagatatactcagcctaacccagtggcttaacacaaggagattggctttgatctttttttcttgtggcatcttccagcaagttagaagtctcatgggataagactgcagttcccctggttcaatagctggaacagtgattttaaatgtccctttttctggatcccttgtaaacatgaaatcattccatggatggctgccttataattttgtctctttccactttaattgtgaatggttaaaaaaatgctgttttctgatattaaatttttattagtgc

SEQ ID NO: 6371 - DNA, 2838 bp, Homo sapiens
ctggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggg

SEQ ID NO: 6372 - DNA, 4246 bp, Homo sapiens
gcggagcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtgtctgcctca

SEQ ID NO: 6373 - DNA, 4069 bp, Homo sapiens
gcagtcgcggctgcgctcgggagagagcgcgggggacatggggcgcggcggcccgcctgggcctcgcaggctccggagccccgagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtgtctgcctca

SEQ ID NO: 6374 - DNA, 4210 bp, Homo sapiens
gcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgagggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagcctggaggggtccctggatgctggtctggagccaaatggcagctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtgtctgcctc

SEQ ID NO: 6375 - DNA, 4454 bp, Homo sapiens
ggggaggggaggctaaaagcagggttggggagcgaatctgggggattgtgggaatatcgggccgcgccccagcccccagcgatgcgtggggcgcctggagaaggggcgcacgggcaggtggggtgctgcggggcccgcgcgtgggggccgcgccggccggggcggggtgagtcacggcccgcccgctcccattgtgcggcccggcggcggcggcggcggcggcggcggcggcggaggtgcggagcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgagggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 6376 - DNA, 4134 bp, Homo sapiens
cccagcccccagcgatgcgtggggcgcctggagaaggggcgcacgggcaggtggggtgctgcggggcccgcgcgtgggggccgcgccggccggggcgggggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtg

SEQ ID NO: 6377 - DNA, 4300 bp, Homo sapiens
gcggagcgcgaggaggtggagccgcgggctgcgggctccggcgcctgcgtccgcccggccagcccggctctgcgctgcgagaggccggacggcagtcgcggctgcgctcgggagagagcgcgggggacatggggcgcggcggcccgcctgggcctcgcaggctccggagccccgagggctccccgctaggccccctcagtggcccctccttctcacctgggtctcgggtcccctagtgagcgagagcgtccccagccgcctacctggccatggccaacggagtgatcccgccgcccgggggcgcctcccccctaccccaggtccgggtgcccttggaggagccccctctaagtccagacgtggaggaggaggacgatgacttgggcaagaccttggctgtgagcaggtttggggacctcatcagcaagcccccggcctgggaccccgagaagcccagccgcagctacagcgagcgggactttgagtttcaccggcacacatcccaccacacccaccacccgctctcagcgcgcctgcctccaccccacaagctgcggcggctgccccccacctctgcccggcacaccaggagaaagaggaagaaggagaaaacctctgctcctccctccgaggggacccctcccatccaggaggaggggggagctggagtggatgaggaagaggaggaagaggaggaagaggaaggagaatctgaggcagaacctgtggagcccccccactcagggaccccacagaaggcaaagttctccattggaagtgacgaggatgacagtccaggcctccctgggagggctgctgtcaccaagcccctgccctcggtgggcccacacactgacaagagcccccagcactccagcaggccgtgctctgagctgagggacggtgatggaaccaccgacctggccctgtcaagtccaaggctgctgtgttgcctccccagctcccccagcccccgggcccgggcctcccgactcgctggggagaaaagccggccctggagcccatcggccagttatgacctgcgggagcgactgtgcccaggcagtgccctgggcaacccaggtggtccagagcagcaggtgcccacagatgaggcggaggcccagatgctgggttctgcagacctggacgacatgaagagtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacagccatcccaacgatgacaaggacagtggcttctttccccgaaacccatcgagctccagcatgaactcggttctggggaatcatcacccaactcccagccatggccctgatggggcggtgcctaccatggctgatgacctgggggagccagccccactctggccacatgaccctgacgccaaggagaagcccctccacatgcctgggggagatggtcaccgggggaaaagcctgaagctgctggagaagatccctgaagatgctgaggccacggttgtgcttgtgggttgtgtgcctttcttggagcagcctgcagcagccttcgtgcgtctgaatgaggctgtactcctggagtctgtgcttgaggtccctgtcccggtccgcttcctcttcgtgatgctggggcccagccacaccagcactgactatcacgagcttgggcgctccattgccacccttatgtctgacaagctgtttcatgaggctgcctaccaggcagatgaccggcaagacctcctaagtgccatcagcgagttcctggatggcagcattgtgatccccccgtccgaggtggagggccgtgacctgctgcgctccgtggctgctttccagcgagagctgcttaggaagcggcgagagcgtgaacagaccaaagtcgagatgaccacacggggtggctacacggcccctgggaaagaactgtctttggagttggggggctctgaagcaacccctgaagatgaccccttgctgcggacgggctcggtatttggggggcttgtgcgggatgtgaggcgccggtacccgcactaccccagtgacctgcgagatgcgctgcactcccagtgtgtggccgctgtgctcttcatctacttcgcagccctcagccctgccatcaccttcggggggctgctgggagagaagaccgaggggctgatgggcgtgtccgagctgatcgtgtccaccgctgtgctcggcgtcctcttctctctgctgggagctcagccgctgcttgtggttggcttctctgggccgctgcttgtgtttgaggaagccttcttcaagttctgccgagcccaggacctggagtacctcactggccgggtgtgggttggtctctggctggtggtcttcgtccttgccctggtggccgccgaaggcagcttcctggtccgctacatctcgcctttcacccaggagatctttgcctttctcatctcactcattttcatctacgagaccttctacaagctctacaaggtgttcacagagcacccactgctgccgttctacccccctgagggggccctggaggggtccctggatgctggtctggagccaaatggcagtgccctgccccccaccgagggcccccccagcccgaggaaccagcccaatacggcactgctctcactcatcctcatgctcgggaccttcttcatagccttcttcctgcgcaagttcaggaacagccgcttcctggggggcaaggctcgtcgcatcatcggggactttggcatccccatctccatcctggtgatggtcctggtggattactccatcacagacacctacacgcagaagctgacagtgcctacagggctctcagtgacctctcccgataagcgctcgtggttcatcccacccctgggcagtgcccgtcctttcccgccgtggatgatggtggcagccgctgttcccgccctcctcgtcctcatcctgatcttcatggagacacagatcacggcgcttatcgtcagccagaaggcgcggaggctgctcaagggctccggtttccacctggacctgctcctcattggctccctgggggggctctgtgggctgtttgggttgccctggctcacggctgccacggtccgctccgtcacccatgtcaatgcgttgacagtgatgcgtactgccatcgcgcctggtgacaagccccagatccaggaggtgcgggagcagcgggtcactggtgtgctcatcgccagcctcgtgggcctgtccatcgtcatgggggctgtgctgcgtcggatcccattggctgtgctctttgggatcttcctgtacatgggggtcacgtccctgtctggtatccagctgtcccagcgtttgttgctcatcctcatgccggcaaaacaccatcctgagcagccctatgtgaccaaggtgaagacgtggcggatgcatctgttcacctgcatccagctgggctgcatcgcactgctctgggtggtcaagtccacggcggcctcactcgcctttcccttcctgctgctgctcacggtgcctctgaggcattgccttctgccccggctcttccaggacagggagctgcaggcgctggactcggaagatgctgaaccaaacttcgatgaggatggccaggatgagtacaatgagctgcacatgccagtgtgacccttgaagacagtgcccctcagagaccccaagaccttagggattgacacctgggcctcaggcagagcccagccctgggctggggggctcctcaggacccagagatgtgcctggaaccactcctgatgccatggctagagtggcccccctgacttctgcccggggtgttgacctcgcctcacctttcacagaccagaccggcacaggctttgagctcattataaccacactccttgtctcgtgtctgcctc

SEQ ID NO: 6378 - DNA, 792 bp, Homo sapiens
ccaccttcagctctggttggacagaagccaccccgtccaggctcccaccttgtaggagagccgaggggtctggtagggagcggaggccgaggtctcggccaccgggagaatgacgagcccactggagaaggaccctgagcccaatggggcactgagccctgggcctggggataccaatagctggggctttgggagggatccagcccccagtcctcgagactcactggccccggaagacttagagatgtttgtgctggactttgaggatggtgacctgtgggagtccatcaggggccagctgggccccatggcagggccaccaacttgtcaccgactggaggacaaccctggtgtgcggcgacacttagtgaaaaagccctcccggacgcagggcgggaggggcagtcccagcggcctggcccccatccttcgcaggaagaagaagaagaaaaagctggaccggaggcctcatgaggtgttcgtggagctgaacgagctgatgctggaccgcagccaggagccccactggcgggagacggcccgctggatcaagtttgaggaggacgtggaggaggagacggagcgctgggggaagccccatgttgcctcgctctccttccgtagccttctggagctcaggaggaccatcgcccatggagctgccctcctggacctggagcaaaccaccctgccaggcattgcacacctcgtggtggagaccatgattgtgtctgaccagatccggccggaggacagggccagcgtcctacgtaccctgctactgaagcacag

SEQ ID NO: 6379 - DNA, 3343 bp, Homo sapiens
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaagcgcttcccattttgaactttctgtcctcacagattctgtttgacagaatctaagggccatcagggaactcttttcatcttgcaaagagaaaaagccagtctttccagaataaatattcatctgttt

SEQ ID NO: 6380 - DNA, 3086 bp, Homo sapiens
ctggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctga

SEQ ID NO: 6381 - DNA, 3144 bp, Homo sapiens
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacgaa

SEQ ID NO: 6382 - DNA, 3258 bp, Homo sapiens
tctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagagagacaggcagctcctctgcatctctgctcctggacatgggagaaatgccctcaataacactgtctacccaccttcatcacaggtgggtactgtttgaggagaagttggaggtggctgcaggccggtggagtgccccccacgtgcccaccctggcactgcccagcctccagaagctccgcagcctgctggccgagggccttgtactgctggactgcccagctcagagcctcctggagctcgtggagcaggtgaccagggtggagtcgctgagcccagagctgagagggcagttgcaggccttgctgctgcagagaccccagcattacaaccagaccacaggcaccaggccctgctggggctctactcatccaagaaaggcttctgacaatgaggaagcccccctgagggaacagtgtcagaaccccctgagacagaagctacctccaggagctgaggcagggactgtgctggcaggggagctgggcttcctggcacagccactgggagcctttgttcgactgcggaaccctgtggtactggggtcccttactgaggtgtccctcccaagcaggtttttctgccttctcctgggcccctgtatgctgggaaagggctaccatgagatgggacgggcagcagctgtcctcctcagtgacccgcaattccagtggtcagttcgtcgggccagcaaccttcatgaccttctggcagccctggatgcattcctagaggaggtgacagtgcttcccccaggtcggtgggacccaacagcccggattcccccgcccaaatgtctgccatctcagcacaaaaggcttccctcgcaacagcgggagatcagaggtcccgccgtcccgcgcctgacctcggctgaggacaggcaccgccatgggccacacgcacacagcccggagttgcagcggaccggcaggctgtttgggggccttatccaggacgtgcgcaggaaggtcccgtggtaccccagcgatttcttggacgccctgcatctccagtgcttctcggccgtactctacatttacctggccactgtcactaatgccatcacttttgggggtctgctgggagatgccactgatggtgcccagggagtgctggaaagtttcctgggcacagcagtggctggagctgccttctgcctgatggcaggccagcccctcaccattctgagcagcacggggccagtgctggtctttgagcgcctgctcttctctttcagcagagattacagcctggactacctgcccttccgcctatgggtgggcatctgggtggctaccttttgcctggtgctggtggccacagaggccagtgtgctggtgcgctacttcacccgcttcactgaggaaggtttctgtgccctcatcagcctcatcttcatctacgatgctgtgggcaaaatgctgaacttgacccatacctatcctatccagaagcctgggtcctctgcctacgggtgcctctgccaatacccaggcccaggaggaaatgagtctcaatggataaggacaaggccaaaagacagagacgacattgtaagcatggacttaggcctgatcaatgcatccttgctgccgccacctgagtgcacccggcagggaggccaccctcgtggccctggctgtcatacagtcccagacattgccttcttctcccttctcctcttccttacttctttcttctttgctatggccctcaagtgtgtaaagaccagccgcttcttcccctctgtggtgcgcaaagggctcagcgacttctcctcagtcctggccatcctgctcggctgtggccttgatgctttcctgggcctagccacaccaaagctcatggtacccagagagttcaagcccacactccctgggcgtggctggctggtgtcaccttttggagccaacccctggtggtggagtgtggcagctgccctgcctgccctgctgctgtctatcctcatcttcatggaccaacagatcacagcagtcatcctcaaccgcatggaatacagactgcagaagggagctggcttccacctggacctcttctgtgtggctgtgctgatgctactcacatcagcgcttggactgccttggtatgtctcagccactgtcatctccctggctcacatggacagtcttcggagagagagcagagcctgtgcccccggggagcgccccaacttcctgggtatcagggaacagaggctgacaggcctggtggtgttcatccttacaggagcctccatcttcctggcacctgtgctcaagttcattccaatgcctgtgctctatggcatcttcctgtatatgggggtggcagcgctcagcagcattcagttcactaatagggtgaagctgttgttgatgccagcaaaacaccagccagacctgctactcttgcggcatgtgcctctgaccagggtccacctcttcacagccatccagcttgcctgtctggggctgctttggataatcaagtctacccctgcagccatcatcttccccctcatgttgctgggccttgtgggggtccgaaaggccctggagagggtcttctcaccacaggaactcctctggctggatgagctgatgccagaggaggagagaagcatccctgagaaggggctggagccagaacactcattcagtggaagtgacagtgaagattcagagctgatgtatcagccaaaggctccagaaatcaacatttctgtgaattagctggagtaggagtctgggagtggagaccccaggaaacagcatgagttcacaggtgcttactcaggaagtcaggacatttttggcctttggcttaacttccagatgctcagtcggcttggggaaggactgaagggcagctgccaagacctcagttacctcctgacctgagggtggagagtggcaggaagcaagcatgtttgctgtgcacttaggaaaggctggtgagccagagggactgatcaggccccattcactctctactcattaaaaggtcctgagccacg

SEQ ID NO: 6383 - DNA, 2595 bp, Homo sapiens
gctctgggagtgtgaaactgggagagacggttaagctggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 6384 - DNA, 2619 bp, Homo sapiens
gagcggcccccggaggctttcctggtagaagttgatgcgaggaagggcggcggggaccaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggcaa

SEQ ID NO: 6385 - DNA, 2617 bp, Homo sapiens
gcgaatgcgaacctggcccgtgcggaaagggcgcggagagccccggcgcggagcaggcgggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttcaggtgaagagtgaggttgtcatggcctcagctatgcttcctggctctccctcaagagtgcagccttggctagagaactcacagctctgggaaaaagaggagcagacagggttccctgggcccagtctcagcccagccactgatgctggatgaccttggcctgaccctggtctggtctcagaatcacttttcccatctgtaaaattgagatgaattttggtgttgaaagttcttcctggagcagatgtcctagaaggttttaggaatagtgacagagtcaggccaccccaagggccatgggagccagctgacctgcttgaccgaaggatttctgacagactatctttggggatgttttcaagaagggatataagttatttactttgggcatttaaaagaaaatttctctcgggaataattttatagaaaaataaagcttctgtgtctaaggc

SEQ ID NO: 6386 - DNA, 539 bp, Homo sapiens
gcgaacctggcccgtgcggaaagggcgcggagagccccggcgcggagcaggcgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcct

SEQ ID NO: 6387 - DNA, 801 bp, Homo sapiens
acattttccctaggtgggcctgagcgagtaacagcattcaactaacttggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcc

SEQ ID NO: 6388 - DNA, 562 bp, Homo sapiens
gcaaaatgcacaaatagagtgtgtgtgtccctatgccctcatgtgctgtctgtgtgtcctctgggtgctgggtgtgacattttccctaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctggaaggct

SEQ ID NO: 6389 - DNA, 653 bp, Homo sapiens
gggacggtattcagaattcgagcgcaggagctccgcttctccacctgctcccggggagctattgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattggg

SEQ ID NO: 6390 - DNA, 560 bp, Homo sapiens
gaatgcgaacctggcccgtgcggaaagggcgcggagagccccggcgcggagcaggcgggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctg

SEQ ID NO: 6391 - DNA, 2207 bp, Homo sapiens
agtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtgccccctggaatggcctgctcatggaccggcttaaacagaagtaccagaaggaagcaagaaagacaggttcctccactttggcggtggccctctgctcgacggtgccttcgctggccctgacatccctgctgtgcctgggcttcgccctctgtgcctcagtccccatcctccctctccagtacctcaccttcatcctgcaagtgatcagccgctccttcctctatgggagcaacgcggccttcctcacccttgctttcccttcagagcactttggcaagctctttgggctggtgatggccttgtcggctgtggtgtctctgctccagttccccatcttcaccctcatcaaaggctcccttcagaatgacccattttacgtgaatgtgatgttcatgcttgccattcttctgacattcttccacccctttctggtatatcgggaatgccgtacttggaaagaaagtccctctgcaattgcatagttcagaagccctcacttttcagccccgaggatggttttgttcatcttccaccacctttgaggacctcgtgtcccaaaagactttgcctatcccagcaaaacacacacacacacacacacacacacaaaataaagacacacaaggacgtctgcgcagcaagaaaagaatctcagttgccaagcagattgatatcacacagactcaaagcaaaggcatgtggaacttctttatttcaaaacagaagtgtctccttgcacttagccttggcagacccttgactccaggggagatgacctgggggaggaagtgtgtcaactatttctttaggcctgtttggctccgaagcctatatgtgcctggatcctctgccacgggttaaattttca

SEQ ID NO: 6392 - DNA, 397 bp, Homo sapiens
gggaggctgaaaggcagcgaggagggagggaaagacaccgctggggttctagggggttctagagggagaagtttcaagagggagaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggc

SEQ ID NO: 6393 - DNA, 1434 bp, Homo sapiens
tttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccaccgccacactcatcatagccttcacctctgcaggctcagccgtgctgctcttcctggccatgccaatgctcaccattgggggaatcctgtttctcatcaccaacctgcagattgggaacctatttggccaacaccgttcgaccatcatcactctgtacaatggagcatttgactcttcctcggcagtcttccttattattaagcttctttatgaaaaaggcatcagcctcagggcctccttcatcttcatctctgtctgcagtacctggcatgtagcacgcactttcctcctgatgccccgggggcacatcccatacccactgccccccaactacagctatggcctgtgccctgggaatggcaccacaaaggaagagaaggaaacagctgagcatgaaaacagggagctacagtcaaaggagttcctttcagcgaaggaagagaccccaggggcagggcagaagcaggaactccgctccttctggagctacgctttctctcggcgctttgcctggcacctggtgtggctgtctgtgatacagttgtggcactacctcttcattggcactctcaactccttgctgaccaacatggccggtggggacatggcacgagtcagcacctacacaaatgcctttgccttcactcagttcggagtgctgtgtg

SEQ ID NO: 6394 - DNA, 573 bp, Homo sapiens
gcgaatgcgaacctggcccgtgcggaaagggcgcggagagccccggcgcggagcaggcggtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaagg

SEQ ID NO: 6395 - DNA, 506 bp, Homo sapiens
tttcgggcgccatggggcgccgagcgcggcctggcccctcgggctcctctgcggggagggcaggccgcaggctggagcggggtgcggaggctggcggggagcggcccccggaggctttcctggtagaagttgatgcgaggaagggcggcggggaccagtaaactgaagataacaccaacttggcagcgggagtttgtgtcttctgtatgaaatctccctgcctctgcacctggttgagttgctgtcattattttaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggc

SEQ ID NO: 6396 - DNA, 587 bp, Homo sapiens
atgtgctgtctgtgtgtcctctgggtgctgggtgtgacattttccctaggggacggtattcagaattcgagcgcaggagctccgcttctccacctgctcccggggagctattgggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccac

SEQ ID NO: 6397 - DNA, 571 bp, Homo sapiens
gcgaacctggcccgtgcggaaagggcgcggagagccccggcgcggagcaggcgggggacggtattcagaattcgagcgcaggagctccgcttctccacctgctcccggggagctattgggcctcctcttccagcagcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtcct

SEQ ID NO: 6398 - DNA, 581 bp, Homo sapiens
aaatagagtgtgtgtgtccctatgccctcatgtgctgtctgtgtgtcctctgggtgctgggtgtgacattttccctaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttcta

SEQ ID NO: 6399 - DNA, 589 bp, Homo sapiens
gcgaatgcgaacctggcccgtgcggaaagggcgcggagagccccggcgcggagcaggcggcctctatctttattctacaggatccagagaatcacccgctgatggtttttgcccaggcctgaaacaaccagagagctacgggaaaggaagggcttggcttgccagaggaattttccaagtgctcaaacgccaggcttacggcgcctgtgatccgtccaggaggacaaagtgggatttgaagatccactccacttctgctcatggcgggccagggcctgcccctgcacgtggccacactgctgactgggctgctggaatgcctgggctttgctggcgtcctctttggctggccttcactagtgtttgtcttcaagaatgaagattactttaaggatctgtgtggaccagatgctgggccgattggcaatgccacagggcaggctgactgcaaagcccaggatgagaggttctcactcatcttcaccctggggtccttcatgaacaacttcatgacattccccactggctacatctttgaccggttcaagaccaccgtggcacgcctcatagccatatttttctacaccac

SEQ ID NO: 6400 - DNA, 1943 bp, Homo sapiens
gcgtacaggaggcggcggcggctcccagtcaccggcccccgccggcgagcgcacgatgcactgcctgggcgccgagtacctggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaagggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctc

SEQ ID NO: 6401 - DNA, 2045 bp, Homo sapiens
acaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaagggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctca

SEQ ID NO: 6402 - DNA, 2388 bp, Homo sapiens
cagccccagccccggccccggccccggctcgcgggcgctgcgtctccgcgtacaggaggcggcggcggctcccagtcaccggcccccgccggcgagcgcacgatgcactgcctgggcgccgagtacctggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctcattgtctttgtcattattgtttgaccaggtaacaatactggaactatattagtttacctttttttgtacaaattaggacagaaaaactcttctaaaaccatgtttatatgcatcaacttacaaagtacactatgtaagaactgaggtaagtttgtaagtgcacaactaataaataaacctttttaagataagga

SEQ ID NO: 6403 - DNA, 684 bp, Homo sapiens
ctccagtgctggggcggaggcgggggagacgcgggccgcggggcgcaaacttggggtcgtcctcaggtgcacctccaggtttctgcagaaggagcccctaggcaaagggagtggcgaccccagatttataggaaatgcacagatacggcatggttattcctgttctttctcttttggactggtttggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcggga

SEQ ID NO: 6404 - DNA, 2094 bp, Homo sapiens
cccagccccagccccagccccggccccggccccggctcgcgggcgctgcgtctccgcgtacaggaggcggcggcggctcccagtcaccggcccccgccggcgagcgcacgatgcactgcctgggcgccgagtacctggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctc

SEQ ID NO: 6405 - DNA, 2061 bp, Homo sapiens
ctggcggggaggaacctggaccctgctccagtgctggggcggaggcgggggagacgcgggccgcggggcgcaaacttggggtcgtcctcaggtgcacctccaggtgtttatcatgggctactcggtggtggctggagccgcgggaagactcctctttggctatgacagctttggcaacatgtgtggcaagaagaactcccccgtggaaggggcccctctttcagggcaggacatgaccctaaaaaaacacgtgttctttatgaattcctgcaacctggaagtcaaaggtacgcagctcaaccgcatggccctctgtgtatccaactgccctgaagagcagcttgactccctggaagaggtccagttctttgcaaacaccagtgggtccttcctgtgtgtttatagtttgaattccttcaactatacccacagtccaaaagcagactcactgtgtcccaggctaccagttcctccaagcaagtcatttcccttatttaaccgatgtgtccctcaaacacctgagtgctactccctatttgcatctgttttgataaatgatgttgacaccctccaccgaattctaagtggaatcatgtcgggaagagatacaatccttggcctgtgtatcctcgcattagccttgtctttggccatgatgtttaccttcagattcatcaccacccttctggttcacattttcatttcattggttattttgggattgttgtttgtctgcggtgttttatggtggctgtattatgactataccaacgacctcagcatagaattggacacagaaagggaaaatatgaagtgcgtgctggggtttgctatcgtatccacaggcatcacggcagtgctgctcgtcttgatttttgttctcagaaagagaataaaattgacagttgagcttttccaaatcacaaataaagccatcagcagtgctcccttcctgctgttccagccactgtggacatttgccatcctcattttcttctgggtcctctgggtggctgtgctgctgagcctgggaactgcaggagctgcccaggttatggaaggcggccaagtggaatataagcccctttcgggcattcggtacatgtggtcgtaccatttaattggcctcatctggactagtgaattcatccttgcgtgccagcaaatgactatagctggggcagtggttacttgttatttcaacagaagtaaaaatgatcctcctgatcatcccatcctttcgtctctctccattctcttcttctaccatcaaggaaccgttgtgaaagggtcatttttaatctctgtggtgaggattccgagaatcattgtcatgtacatgcaaaacgcactgaaagaacagcagcatggtgcattgtccaggtacctgttccgatgctgctactgctgtttctggtgtcttgacaaatacctgctccatctcaaccagaatgcatatactacaactgctattaatgggacagatttctgtacatcagcaaaagatgcattcaaaatcttgtccaagaactcaagtcactttacatctattaactgctttggagacttcataatttttctaggaaaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctgagtttcgtaaaaaggagcaacaaattaaacaatgcaagggcacagcaggacaagcactcattaaggaatgaggagggaacagaactccaggccattgtgagatagatacccatttaggtatctgtacctggaaaacatttccttctaagagccatttacagaatagaagatgagaccactagagaaaagttagtgaatttttttttaaaagacctaataaaccctattcttcctca

SEQ ID NO: 6406 - DNA, 4406 bp, Homo sapiens
aggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattcaggcaatttttgaaaacactataaatgtgtaattaattagccataaaatattgatttatagttaaccagcatatggtactaaatttgtaaatatggtgctatggttatatttatactgttcaagctggtggacaactctctaaactgtgattaaacttgtattaatggttccctaggaagtatatttcagtgagtcatgtccataacaaacatagatgttaatgttatataggttctacggagagcattactgggtaaaaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaagttgaaaaaatcacttg

SEQ ID NO: 6407 - DNA, 3896 bp, Homo sapiens
acagtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatactaagatcatttgttttgtaattcgtttttaaagagtggcttggatgttttgaaaatactactgaatatgttaatattcttttaaatcttagattgaaaaatgatacattacttaaattgatagctcctaatatatttttaaaattacaactaaaagaagacttcttctgcagggaaaattggtcagcaaagtgaaattaaaaattttaaagtttttcccactctcgttggacagtaaatcagtgaaaggactgccccagttgagagtttgctctctttaagtatagaatgtttcctcttaaacaaattgccaatcatccagcctttactacttagccctctgacaaagtgccttactggctatttaatattacccagcttttatgggcaagtttacaaacattgttttttaaaaaattaaaacctgcaatgtttcgtgattaaaacaagtcttattgcatttgtttcactcttagctcactgattggaaaacatttgtcattttgctctgtttgatatcctcactattatggaatacattgtgcagctaaacaatttcccttgcgcctagtggacattcatgaatgtgtactacacgcaagaagaaacaaaccccgaaagaacacttgttggatttctttgtttttttttttactaaaagagaagttttaaaatgaaatgttttctatagtagatctttgaaaatacaataggtataatactgcatttctcagtgttttacaaagatcagaaagagaaacttctaggaattgcaaagggaaactttactcctcgaaagggtgctcacagatgtcatgtactgaatagctcccttttaaatgatcatttattttcatcaaagcctgttctatatatgccacttcattttctaacttttggtatgaaaaaatcagtttacttacagtatgttaattgtattgtactactataaacaggaacataatttccaattcagttttaaataattttaccagtactactaacttttaaggaaattaattcagttggttactcagtgtttgttacagaaagagtccagaaaagtattcaccctaagagaatgtcaatcatataatgataatttgtgaaagctttgagaatcaatcatcagtaagttactatcagtttataaaatattatcacatttgtttaaatgtgactttagatacttttatgccaaaaataaactcacatgagcacatgacagtctgagctctataatcagtgtgcttctgctgtgcagaaatgttagaaacgtattgtctaaatatctttgataattaaaatgtttaatatttaatgaaatttgttgttacttgttttaaatcttttttcttttaataaagatttaaataagaaat

SEQ ID NO: 6408 - DNA, 2416 bp, Homo sapiens
tgtgctttttcctagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtgggaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattca

SEQ ID NO: 6409 - DNA, 2356 bp, Homo sapiens
actaaggccaagaaaaggccttcaaatgcaggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtca

SEQ ID NO: 6410 - DNA, 2486 bp, Homo sapiens
atgagcagggtacctcagttcaaaatgcagaaatcacctgccttctgcgttgatcttgctggaagccacagaccagagctgtttctatttggccatcttgccagccacctctttttgtgctttttcctagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttcttggaagatttagaaagaaatgatggttctactgcaagaccttattatgtgagtcaacctttgctgaagattttccaggaggaaaatccacaaactaggaagcagtagaagagcaaactggtcgtcctacagctgtgtgttaccttttctccatctgctgtgtctgtgcaacatttgtttcataagtgctttgtgtttagcaacactgtattcacgaccttgttggcttgcatttgcatgttttataccaaagcttatactgtactatgtgaagccatcagaagtcgcaagggaattgttaataacataaaacatttttatac

SEQ ID NO: 6411 - DNA, 3178 bp, Homo sapiens
gcgccgcgctgaggccgaggtccgcagggccgcggggaagccgagggctgccggagaaccctgcaggtgtcactcgggacgcggaagtgcgcttgccgaggtttgctttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtgggaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggaagttcagaaaaaagtgtcacgttttaatctgcagatggacataagtggattaattcctggtctagtgtctacattcatacttttgtctattagtgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagtggtcgtttctaattattgctgtgtctcttgctgttaatttgatctatattttattttttctcggagatccagtgaaagagtgttcatctcagaatgttactatgtcatgtagtgaaggcttcaaaaacctattttaccgaacttacatgctttttaagaatgcttctggtaagagacgatttttgctctgtttgttactttttacagtaatcacttatttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacaggtgactgtgatttaaacaaacaaaaaaaatctatgaatgcacatatcatataccatgacttctgaagactataaatgaattccacaatcagtgcttcactgagaaccaattttacctatcttttcttctaaactgaacagtcagagagacagctcctggctttagcttcttgtggtaccacgcactttgagcactttgtgcgtatcatgcaatatacttgcaatacacagaacaaatttcaaatacgcctcacttttagacttagaagagaaacattaaaacttaagggtgtaaggagggatcaagaaacttgataaggtcaaaagcaataatctctctgacatattccaggctcttacactgagaccaaagagaaatctttacctcagtttcttcatcagcagaatgggtttctggcctctctcagggataattttgaaggcataatgaaaattatgatgaatcactcattggtaggaaaataatgatataagtttcaaatatgtatgattttacctatacttggtaatgctttattttatagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaaaaaactgaatgaacagctaatactggtataaagtaactaatgtttggagccaacatttgttccttgtgtcagcaaaaggatattcacattccatgatccctggctgagaattctgcctctagtctttcttacccagctgttgtctatccttgttcaattataaatactgctaagggcatttttaaaatacgatcttgtactccttaaatttgaatccgtcaacacggtcactcataggaaaatgatcaaacaagcaagccagtcatgatttgactccttcccatctcatttcttactgccttacgctcatcctgaggtccaccttggtctctaaaaacaccatgtgttctcatgcctccatgtcttttcacacactgttccatttgctcttcctcccacattacattgaaactttcaagcctcagtcgaaacattgcttcttctggatagcagccttcttgacatccctcctcactccccagtccctacagggcttccatagctctttgtgtgcacttcgatcccagcattttccatcgacttgtaattgtttctgctacctgacaatcatcgccttgagtactgggacaacctttgattactcattatatcctcaataaatatttgttgaactaaactaaa

SEQ ID NO: 6412 - DNA, 2121 bp, Homo sapiens
ggacagcgatgctcagctggctgcggccgagtcatcgcctagcgctggcagggccgctgaccgaccgacggaggcgccgattggccgattgtccactgcgcagaaggagcagctgctccgcgccccgccgcgccgcgctgaggccgaggtccgcagggccgcggggaagccgagggctgccggagaaccctgcaggtgtcactcgggacgcggaagtgcgcttgccgaggtttgctttacaatacgcttgagactccccgacaagcgtaatttggtcgagttcgacgggaaagtactctccccaccccagcgccggccgcgtagtccgaggttactgtccccggcgcgtcctctgttgccccagtccagaggctgcccttgaacccgggcgcgcacgagcgcagggcatccgaggcgacagcccctggcacggcccgacctgtacccagcctggcaggaagactgtaatcgtgggaatacagctacctacccaggcaatatgaagattttatttgtagaacctgccattttccttagtgcatttgctatgactttgaccggtccactgacaacgcaatatgtttatcggagaatatgggaagaaactggcaactacactttttcatctgatagcaatatttctgagtgtgaaaaaaacaaaagcagcccaatttttgcattccaggaggaagttcagaaaaaagtgtcacgttttaatctgcagatggacataagtggattaattcctggtctagtgtctacattcatacttttgtctattagtgatcactacggacgaaaattccctatgattttgtcttccgttggtgctcttgcaaccagcgtttggctctgtttgctttgctattttgcctttccattccagcttttgattgcatctaccttcattggtgcattttgtggcaattataccacattttggggagcttgctttgcctatatagttgatcagtgtaaagaacacaaacaaaaaacaattcgaatagctatcattgactttctacttggacttgttactggactaacaggactgtcatctggctattttattagagagctaggttttgagtggtcgtttctaattattgctgtgtctcttgctgttaatttgatctatattttattttttctcggagatccagtgaaagagtgttcatctcagaatgttactatgtcatgtagtgaaggcttcaaaaacctattttaccgaacttacatgctttttaagaatgcttctggtaagagacgatttttgctctgtttgttactttttacagtaatcacttatttttttgtggtaattggcattgccccaatttttatcctttatgaattggattcaccactctgctggaatgaagtttttataggttatggatcagctttgggtagtgcctcttttttgactagtttcctaggaatatggcttttttcttattgtatggaagatattcatatggccttcattgggatttttaccacgatgacaggaatggctatgaccgcgtttgccagtacaacactgatgatgtttttagccagggtgccgttccttttcactattgtgccattctctgttctacggtccatgttgtcaaaagtggttcgttcgactgaacaaggtaccctgtttgcttgtattgctttcttagaaacacttggaggagtcactgcagtttctacttttaatggaatttactcagccactgttgcttggtaccctggcttcactttcctgctgtctgctggtctgttactacttccagccatcagtctatgtgttgtcaagtgtaccagctggaatgagggaagctatgaacttcttatacaagaagaatccagtgaagatgcttcagacagagcctgttaagctgctattgatagtcggagcttatatactgtgacttctgaagactatacatgaattccacaatcagtgctttgttgatacaaaatccttaaaagggaggcactttaaagaatatgtatttttcacttttcttaatatgtttcatcggtgacaggcatgataatatttctatatgtaatgggtaattgggaaaaaatagatgataaataaaattgctctaaagaagttaa

SEQ ID NO: 6413 - DNA, 951 bp, Homo sapiens
gcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtg

SEQ ID NO: 6414 - DNA, 3010 bp, Homo sapiens
gctctggcggctcccgcggctccggctggcggcttcgggccctgcacctgtgactctcggccgcgctcgccctcggcccgcccggcgccgcagccccatggccccgtccaggctgcagctcggcctccgcgccgcctactccggcatcagctccgtggccggcttctccatcttcctcgtctggacggtggtctaccgacagccggggaccgcggccatgggagggctcgcaggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccctgggggggccttaggacctggactcagcctctgagatgttgggagaggctactcccaccccctggtgaccccagaactgtggcagaaaatacacagcaggacgagtgtggtctcccaggaagctgtcctgcccgtcccctttcgaggaaacctgagtgtggtagagaggggatcctgccatgttgctcctcatcagcctggccagagggcagctttagaccttttcaaatgaatctgttttcttttctttcttttttttttcttttttttttttttttgagatggagtcttactctgtcacccaggctggagtgcagtagtgcgatctcagctcactgcaacctccgcctcccaggttcaagcaattctcctgccttggcctctcaagtagctgggattacaggcatctgccaccatgcccggcaaatttttgtgtttttagtagagacagggttttgccatgttggccaggctggtctcgaactcctgatctcaggtgattcacccgcctcagccttccaaagtgctgggattataggtgtgagccaccgtgcccggcctggatctgttttcttagcacgcagtgaggaatctttgtacttaaggccagggcaacaaagtcaagaggtcaaggtgtagggccatgaggcctggacctatgctgcaggcaagggtttccatccccgctgccctaggcactctcttcccaaggccaggttgggcacctggggaggtcagttcagaaatatctagcagagacctcttaaacccccatcccagcaccccatcctgttgttcccagagctggtctcccatgagtgtgctagagccagatagccgtggccccccacccatctcactcacacacacaggcatccatacaccccagaagacttcccaaatgaggccagactcagggtcacggggaatgtgcttctgcccctgtaagggctttggggaagggggcaacatagtagaggctggaaagagcccccaaacctgtacccatgcccctccagccctgcgtttccattctgccttctcagagtgcccttgctgcacccagaccaccggccaggagagaccttctctcccactccagcccctctcactgcccttcaactagagctttcacctttttacatttcccttctgaaggacacaaatctgcttttctgcccatacactggcccaagggctcacctaacttgggagggaaggggctgttggtacaaggatgattttctgttagactgccattttgcacggtctcccccttcccatctgatgtgtcctgcccctcagctctttgccttatctgtgtcactgtcactttagcaaaaatacagcggccatttgtatcagcctctggtggttgcttgtgaggtgggactcttgcgggaacaggtggactttgggaggagtgggcagggagggagtggtagtggcagttctcgagctatctgattaagccattccgctagttcagttgtgccctggagggcaggggacagagtcagtatctctggggctgcaggccctcttgccttggccctcctggcatggggtaaccaccagctcagctctcctcctccagctttcctctctctagcacaccccagccagggcaaggatgcccacgggcatagctacagcaacccctgcgggatttggtgtccacacccgagaggccaggccagatgggaaagggattagcgcctcttccctcacactctgccaggctgccaggagcttgggccaggtctaaggtaatgaggtgctcctcttcctgctggaaaaaccggacagactcagaaccacaaaggcaggtgctgccagcctggcgccttcctctctgcttaggctgggtgagcttgtccaggcctgtgcctcaccccttctctcttctaggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttcaga

SEQ ID NO: 6415 - DNA, 1024 bp, Homo sapiens
gggaaaaggaggaagagggagttaaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggctcagtgtatgcttaatcaggcatggtgcatcagagcgggaaggagccatcaacagtgtatacttctggagccttctactgataaacagaggccccagaagacgatttgacttacctgagctcccagctgggacttaaacccaggtgtgtctgagtcacaactcttcggggatgccgtggtgagctggggctgagctcctgtattcccactcccccaccccacccccactcctgccatatcagggctggtctctgtggactcagcccagggctgcctcctctttgtcaccccaaagtggggcagccagggacagccagggtgtgttcagaatgggttcttcctgcagggcaggaagggcagattgttaaaggggctgcggcccagaccaccctggtccctcctccggcagtgactcagacccacactgtgccgtgcagctgtgtgccctgcacacccgcttgacggcgcactgctcacttctggggggccctttcagaggcacttttaaagcaaataaaacatttattgttca

SEQ ID NO: 6416 - DNA, 751 bp, Homo sapiens
gccgtgcaggctctagcaaaaggctggggggtccccagcgacccccatcagctttgataaggggatccggagggtgccagtgggtcatctgctgtgtccacacattaagaaacgctggtggagttttaaatgcctctccggggaaggaggaaagcctgagaatgaatctgacctcagacccaaatccattcaacggagttctggtaatttggaagaaggaagagcaacctggaaactgacaggaaaggatgacaagttgggagtcacaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcgtgctggccatcacccggcatcagagcctcacagaccccaccagctactacctctccagcgtctggagcttcatttccttcaagtgggccttcctgctcagcctctatgcccaccgctaccgggctgactttgctgacatcagcatcctcagcgatttctgacccagggggtgaggtctctgcaccct

SEQ ID NO: 6417 - DNA, 618 bp, Homo sapiens
aggtcagagaatggccctagtccatgagcactgaggaagggactttaaggaatccctctcattttgacaaggaaagcaaaagcccagagagatcacacaactatttagaaaggtaggaacagaaagagctgtcttcagacttcttctctgggaggttgatgggttttccccttggctttcgaagagggaggtctggcctcaataactggcagtgctgtcttcctgggactcgggctccaccccttcaccatgggcgtgcatgctcacagctggcactcattccctcacggaagccttccctgggctaaaggcatcatcaagaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggcttcttcttcgtgggcgtcctcttctcggccgtctccatcgctgccttctgcaccttcctcg

SEQ ID NO: 6418 - DNA, 577 bp, Homo sapiens
cgtaggggaagggggccggcactggcaggctttggagtccgcacccgggggtaccagagtggacatccgcctgagcccagagtatccccagggggcaggagcggccccgaagtgtgtggaggaggccgcaacggccggggtgtcagggatccggcggtcatctgctgtgtccacacattaagaaacgctggtggagttttaaatgcctctccggggaaggaggaaagcctgagaatgaatctgacctcagacccaaatccattcaacggagttctggtaatttggaagaaggaagagcaacctggaaactgacaggaaaggatgacaagttgggagtcacaggtatatgatgggcctccccatgtggatccttagtgctgtggcagagcccttgttattgtgctgggattttccctccagctcccggccggaagctgggctcacgtgggagctcagtgccctcctgctacagatctgtctcttccttacaatggggtgctggcactgtgggtcctggtgacgcacgtgatgtacatgcaagattattggaggacctggctcaaggggctgcgcggct

SEQ ID NO: 6419 - DNA, 5152 bp, Homo sapiens
ctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagaagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtgaccccatctaaataaaatactgcttttgcaaacagaacactgtaatagggtagttctggagagatggtatgcagcatacaaaaatatattaaaaatataaacaatgttcaggagagtaaaaattcatataaagtgcaattgcacaaatacaagccaagctagaaggaagcacctatgaaagcaacaactttgtttctcatccatagtagtattgattttgatgctagatagttttgctaggtataaaaaataagtaaagttccacttagagaacaaagggccaaatagagtttttatatttgttatgataaaaggaagtagatgtgaaaaagcctaagaaaaaggaaattggacagttttgatacaaactttgtttgctaatgcactgatgagtctagtttcattatagcacgaagctatgagaataacttcagtcactcccttgaatggtgcaatgaattaaccagctgatttttcttagtgtgatgattaaccccttctttcatgttctgagctataacatttgctgaatatgcaatttgttattcttttattaatggcatgtaatattctgagcacgggcaaagaaaacacacaaaagattatgtattggcatttatttatgtgcaaggtgataggaaaactgaatccatctttgtagaagagcactgggctaatttgtatgtttccatagctactatatgcataaacaacagtacctgaaggattattaagcaaccttaaagcaataagttcattaaacagaaggtaataggaagaacagtacatttttgtctttatctcaagtatataaagttttgccccatgataaaataagtaacatataaattaatacataagttaatattggaagtgaaattaggccttatgtaaggagaggtagctacacagcatctgttacggttaatgagaggcacactgctaaatttacgtatatttcattgaatactttatgggaagcctccacaacacctcctgatagtagtaaaattagaaaaaaacaaactctactaatttttagatattcattaataggaaagatttaatgttacagcatctactctttggcactttttcacataagccagccttagagactagacaaataactactgcaaaaagtacatagtgaattttaaaatgtagaagaaagcaaaaaataaaataagtcctaaagtgaagaagccatcaattttaacatttgatgtctagataacattcatgagattggtcattaaatactattttgctccttttctggtgttacacatacacactcatacgtgtgtgtgtgtgtatgtgtgtgtgtgtatgtgtaatgatttgtgtccatttcaagtgttttcacaccagtcacacattatagaaattactggagccatgtctacaaaagcaaagtgaagtgatgagctgaaaagtgatcagggaatctgatcccataaagaaagtgagtctgaattgttgaaactaaagcacttcttttccaaaaatacttctgcaactcatgaacaaaatgaagttaacttagtgtttagcattaaaaataaaagttgtaccttgaccctagaattccttttataagatttaattgtaattgtctcaaagcatcaaataatacatctttatcattaaacatgaatttaatgtctaggataatttttaaaagaggaaattaaataattttacatgtctcatattttcagtgctttctcaaaatttgatggtgaatattacattgcattcaaaatcttcactgaatatcatatgtatctaaatgaaaagagaattacttatattcatctattttctcagaatctattcagtaccctatggagtacatggaagaagtatatttttggaaccagtaagtatgggagtccacgattctcaggtattgattgaaaaaagagaaaggggcaagaaattcattaaagaaaaaccacagatactgaaacatttgacacataaaagtaattaattgctggagactacaattcctggcaaacaccattattccagatgcaccatgctacccagcatgctacctgaatggcggtttttatccatcctgtcaccctgagcatctgtctcaacctgctgaggcacagacttccaccatgtgcatcaggaaacacctcactcatactgtcatataatgcaacagggaggcatagtctctctacaggtctctctctttacgttgtaccattctgttgggcaacaattgtcccaacaaccacacttaaatccagtggggaaaaaaaggttaacagtaaaaatttcttccacgtaattcaatttctcacaatagacagaaacagggggaaaatgtttgccctgttcaaagtactaaaactagataacttaaataatttaagccaataaataatattatattgtatttaacccattattcctcacctaccctcaaagtaggtatacaaaagactagtttgttattaatccacaaatatgctaaatgttagcaagatgatttttaagtacaaaaaagtttaagattgcaaggaaggaaacaatggtcacaaggtctttacttatgcacatttgtgcataaatttccacccaatttccaagacagttgtatcacaaagctgtgaaatgtgcaagagtatactttgtacccatcatgtgctctgttttgacataatgagtaatgcagacatttacatgttcttccagcttcaatcagtagacctgattttcaaaatctgccctcagatgaaaataaaataaacgaaacatttagacaatggctatattaatctgggaaggcaacacctgtggataaaacattagaagaaaacatatattttattttcatacttttgatatgattgtaacatatttcttgagtaatttaaatgctttgttttcccacacatattcaaatcagcaagcttgtagctggactgcaatatcaacaacaagttgtttcaaacagcatcaaaatacaacttcattgctacacttacaagtaatgaattttatgtgactatgaaacgaatataagcttaaaataagtgaatctaataaaatggctattcctctttttacttggaaataataaattaacattatattttaaacataaa

SEQ ID NO: 6420 - DNA, 2032 bp, Homo sapiens
cgattcccacctcgccctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagacttaatgaagtagccagctgcagaagaatctggatcattagataaaaatggctttccatgtggaaggactgatagctatcatcgtgttctaccttctaattttgctggttggaatatgggctgcctggagaaccaaaaacagtggcagcgcagaagagcgcagcgaagccatcatagttggtggccgagatattggtttattggttggtggatttaccatgacagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtga

SEQ ID NO: 6421 - DNA, 1914 bp, Homo sapiens
gattcccacctcgccctgcgccgcgcgccctccgccggcgccaacacctgtcaactctgcgcgctcccaggttcttggagacgccgagtgaggagccgccctgaccgcccggccccgctccgcactgcaccccgacccaccccgcaccctccctttctgcaccctcgcacccacacccctcgcggttccagggggcggcggccccgggcggagcgctttcgcgtgcagccaccactccagctacctgggtcggaggagggtatatcaatggcacagctgaagcagtttatgtaccaggttatggcctagcttgggctcaggcaccaattggatattctcttagtctgattttaggtggcctgttctttgcaaaacctatgcgttcaaaggggtatgtgaccatgttagacccgtttcagcaaatctatggaaaacgcatgggcggactcctgtttattcctgcactgatgggagaaatgttctgggctgcagcaattttctctgctttgggagccaccatcagcgtgatcatcgatgtggatatgcacatttctgtcatcatctctgcactcattgccactctgtacacactggtgggagggctctattctgtggcctacactgatgtcgttcagctcttttgcatttttgtagggctgtggatcagcgtcccctttgcattgtcacatcctgcagtcgcagacatcgggttcactgctgtgcatgccaaataccaaaagccgtggctgggaactgttgactcatctgaagtctactcttggcttgatagttttctgttgttgatgctgggtggaatcccatggcaagcatactttcagagggttctctcttcttcctcagccacctatgctcaagtgctgtccttcctggcagctttcgggtgcctggtgatggccatcccagccatactcattggggccattggagcatcaacagactggaaccagactgcatatgggcttccagatcccaagactacagaagaggcagacatgattttaccaattgttctgcagtatctctgccctgtgtatatttctttctttggtcttggtgcagtttctgctgctgttatgtcatcagcagattcttccatcttgtcagcaagttccatgtttgcacggaacatctaccagctttccttcagacaaaatgcttcggacaaagaaatcgtttgggttatgcgaatcacagtgtttgtgtttggagcatctgcaacagccatggccttgctgacgaaaactgtgtatgggctctggtacctcagttctgaccttgtttacatcgttatcttcccccagctgctttgtgtactctttgttaagggaaccaacacctatggggccgtggcaggttatgtttctggcctcttcctgagaataactggaggggagccatatctgtatcttcagcccttgatcttctaccctggctattaccctgatgataatggtatatataatcagaaatttccatttaaaacacttgccatggttacatcattcttaaccaacatttgcatctcctatctagccaagtatctatttgaaagtggaaccttgccacctaaattagatgtatttgatgctgttgttgcaagacacagtgaagaaaacatggataagacaattcttgtcaaaaatgaaaatattaaattagatgaacttgcacttgtgaagccacgacagagcatgaccctcagctcaactttcaccaataaagaggccttccttgatgttgattccagtccagaagggtctgggactgaagataatttacagtgaccccatctaaataaaatactgcttttgcaaacagaacactgtaatagggtagttctggagagatggtatgcagcatacaaaaatatattaaaaatataaacaatgttca

SEQ ID NO: 6422 - DNA, 2028 bp, Homo sapiens
ctgcctgcagccatggccagtacggttagccccagcaccatagctgagaccccagagccacctccattgtctgaccacatccgaaatgctgctgacatctcagtcattgtcatctattttctggtggtgatggctgttgggctgtgggcgatgctgaagaccaaccgaggtactataggaggcttcttcctcgctggtcgtgatatggcctggtggccgatgggcgcctctctctttgccagtaacatcggcagcaaccactatgtggggctggctgggacaggagcagcttcaggagtcgccaccgtaacatttgaatggacttcctcagtaatgttgctgattcttgggtggatctttgtccctatctacatcaagtcgggggtgatgaccatgccggaatatctcaagaagcggtttggtggggagcgactccaggtctacctctccatcctctccctcttcatctgtgtggttttgttaatttctgcagacatatttgctggagccatattcatcaagctggccttgggattggacctttacctggcaatcttcatcctcttggctatgactgctgtttacaccaccactgggggcttggcctcggtgatttacacagacaccctccagaccatcatcatgctgattggctcttttattctcatggggtttgcatttaacgaagttggaggttatgagagctttaccgagaagtacgtgaatgccaccccatccgtagtcgagggggacaacttgacaatcagtgccagttgctacacacctcgggcggactccttccacatcttccgagatgctgtgactggggacattccatggccaggaattatatttggaatgcccattacagctttgtggtactggtgcacaaatcaggtcattgtgcagcgctgcctgtgtggcaaggacatgtctcacgtgaaggccgcttgcattatgtgtgcttacctgaagctgctgcccatgttcctcatggtgatgccggggatgatcagccgcatcctgtacacagatatggtagcatgtgtggtaccttctgaatgcgtgaaacactgtggcgttgatgttggctgcaccaactacgcataccccacgatggtgctggaactgatgccccaaggactgcgaggcctgatgctttcggtcatgctggcctctctcatgagctccctgacctccatcttcaacagcgccagcaccctcttcaccattgacctctacaccaagatgcggaagcaagcgtcggagaaagagctcctgatagctggacggatatttgttcttctattaactgttgtgagcattgtgtgggtcccactggtacaagtttctcaaaatggacaactaatccattacacagaatcaatttctagctaccttgggcctccaattgcagctgtctttgtgcttgccatcttctgtaaaagagtcaatgaacagggagcattctggggtctaatggttggacttgcaatgggcctcattcgtatgataacagagtttgcttatggaacagggagttgcttggctcccagtaactgtcccaagattatctgtggagtgcactatctgtacttttccatcgttctcttttttgggtccatgctggtcaccctgggaatttccctcttaacaaaacccattcctgatgtacatctgtaccgcctgtgctgggttcttcggaacagtacagaggagcgaatcgatatagatgcagaagagaaaagtcaggaagaaacagatgatggtgttgaagaagattatcctgagaaatcacgtggatgcctcaagaaagcttatgacttgttctgcggtttgcagaagggacccaagctaaccaaggaggaggaggaagccttgagcaagaagctcacagacacgtctgagaggccctcgtggaggacaatagtgaacatcaacgccatcctcctcctggctgtggtggtctttattcacggctactatgcctgaactctatctgagccattagaataatgaataattctt

SEQ ID NO: 6423 - DNA, 2214 bp, Homo sapiens
ggaggcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagttttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacca

SEQ ID NO: 6424 - DNA, 2201 bp, Homo sapiens
ctagtcctgtatgtgaggactattaattgttttttgttgttgttgttgtttgttttgtgagatggagtctccctctgttgcccaggctggactgcaatggcgcagtcttggctcactgcaatctctacctcctgagttcaagcaattctcctgcctcagcctcccaagtagctgggattacagtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacgcactgggataccctcaacacccccagcccctcaaagccgtctcagcttcctcctgcccgaaacaccaccattggagcggtatctcctaggcctcgtggtcatggatctctggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 6425 - DNA, 2169 bp, Homo sapiens
agtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacgcactgggataccctcaacacccccagcccctcaaagccgtctcagcttcctcctgcccgaaacaccaccattggagcggtatctcctaggcctcgtggtcatggatctctggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctg

SEQ ID NO: 6426 - DNA, 1988 bp, Homo sapiens
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 6427 - DNA, 2069 bp, Homo sapiens
gcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 6428 - DNA, 2140 bp, Homo sapiens
agtccctcgggctcatacctagtgcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtgctcatgtctatgaggagagacaccaagtgtccgtctctcgaacagatgatgtgggctgcgtggtgccgtccgagtgcctgcgggcctgcggggccgaggtcggctgctccaacatcgcctaccccaagctggtcatggaactgatgcccatcggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggagaaaataatgtgacatttcaaaaacagcaccaaagcagtcagcattggaaggaaaattagatttctgacggacatcctga

SEQ ID NO: 6429 - DNA, 1891 bp, Homo sapiens
atacctagtgcctgcggcaggacagccatggccgccaactccaccagcgacctccacactcccgggacgcagctgagcgtggctgacatcatcgtcatcactgtgtattttgctctgaatgtggccgtgggcatatggtcctcttgtcgggccagtaggaacacggtgaatggctacttcctggcaggccgggacatgacgtggtggccgattggagcctccctcttcgccagcagcgagggctctggcctcttcattggactggcgggctcaggcgcggcaggaggtctggccgtggcaggcttcgagtggaatgccacgtacgtgctgctggcactggcatgggtgttcgtgcccatctacatctcctcagagatcgtcaccttacctgagtacattcagaagcgctacgggggccagcggatccgcatgtacctgtctgtcctgtccctgctactgtctgtcttcaccaagatatcgctggacctgtacgcgggggctctgtttgtgcacatctgcctgggctggaacttctacctctccaccatcctcacgctcggcatcacagccctgtacaccatcgcagggggcctggctgctgtaatctacacggacgccctgcagacgctcatcatggtggtgggggctgtcatcctgacaatcaaagcttttgaccagatcggtggttacgggcagctggaggcagcctacgcccaggccattccctccaggaccattgccaacaccacctgccacctgccacgtacagacgccatgcacatgtttcgagacccccacacaggggacctgccgtggaccgggatgacctttggcctgaccatcatggccacctggtactggtgcaccgaccaggtcatcgtgcagcgatcactgtcagcccgggacctgaaccatgccaaggcgggctccatcctggccagctacctcaagatgctccccatgggcctgatcatcatgccgggcatgatcagccgcgcattgttcccaggtctgcgggggctgatgatcgcagtgatgctggcggcgctcatgtcgtcgctgacctccatcttcaacagcagcagcaccctcttcactatggacatctggaggcggctgcgtccccgctccggcgagcgggagctcctgctggtgggacggctggtcatagtggcactcatcggcgtgagtgtggcctggatccccgtcctgcaggactccaacagcgggcaactcttcatctacatgcagtcagtgaccagctccctggccccaccagtgactgcagtctttgtcctgggcgtcttctggcgacgtgccaacgagcagggggccttctggggcctgatagcagggctggtggtgggggccacgaggctggtcctggaattcctgaacccagccccaccgtgcggagagccagacacgcggccagccgtcctggggagcatccactacctgcacttcgctgtcgccctctttgcactcagtggtgctgttgtggtggctggaagcctgctgaccccacccccacagagtgtccagattgagaaccttacctggtggaccctggctcaggatgtgcccttgggaactaaagcaggtgatggccaaacaccccagaaacacgccttctgggcccgtgtctgtggcttcaatgccatcctcctcatgtgtgtcaacatattcttttatgcctacttcgcctgacactgccatcctggacagaaaggcaggagctctgagtcctcaggtccacccatttccctcatggggatcccgaggccccaagaggggcagattcccctcacagctgcacagcagctcggtgcccaagaactggccaagccagcaaagcgggagccctgaaaaattaggggggaaatgggag

SEQ ID NO: 6430 - DNA, 2743 bp, Homo sapiens
ggttgctgttcctgttgctgccactgcggtgagggctgtggctggacgtccctcctggcactttgcctctgtcccctccatccgccgccagcatttttcctcccctccccttcctccagctcgtcccaagcctgcctgtccccagcgtggaggcgggacagtggaagactgggtgagtgaagcaggatggtgccttgggctccagcgtctccccaacccctccatgccatgggtccccacgcaggtgaggaccctggtggaggacggtgtgggcagagcgtgggacatgtcaccttccccacctgctcagagttcaagggtcctgggctgggccccgttctctcttctgccctggggagatcattcacgcttcctttaatccccgctgcagctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagttttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccacaa

SEQ ID NO: 6431 - DNA, 2263 bp, Homo sapiens
gggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagttttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttaccac

SEQ ID NO: 6432 - DNA, 1933 bp, Homo sapiens
gcgggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacc

SEQ ID NO: 6433 - DNA, 2090 bp, Homo sapiens
ataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataagtccacagtgaagaccaaaagagacacagtgaaaggctacttcctggctggaggggacatggtgtggtggccagtgggtgcatccttgtttgccagcaatgttggaagtggacatttcattggcctggcagggtcaggtgctgctacgggcatttctgtatcagcttatgaacttaatggcttgttttctgtgctgatgttggcctggatcttcctacccatctacattgctggtcaggtcaccacgatgccagaatacctacggaagcgcttcggtggcatcagaatccccatcatcctggctgtactctacctatttatctacatcttcaccaagatctcggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagttttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgct

SEQ ID NO: 6434 - DNA, 2156 bp, Homo sapiens
gggacagtggaagactggctgaggctggagtttggagtttgacccgcttggaggctctctcagcagcgggcatataggaggaagggtcactgctgtctccggaagctcttggctgcaaagagagaggatcccgggtatctccctccttacaaccaccgccacctcctagtgccttagaagccactgacagcccccagggcaggtgagccctgcatctggaataaggatccagaggtctcgttcaggaccatggagagcggcaccagcagccctcagcctccacagttagatcccctggatgcgtttccccagaagggcttggagcctggggacatcgcggtgctagttctgtacttcctctttgtcctggctgttggactatggtccacagtgaagaccaaaagagacacagtgaaaggctacttcctggctggaggggacatggtgtggtggccaggcttgttttctgtgctgatgttggcctggatcttcctacccatctacattgctggtcaggtagacatgtatgcaggtgccatcttcatccagcagtctttgcacctggatctgtacctggccatagttgggctactggccatcactgctgtatacacggttgctggtggcctggctgctgtgatctacacggatgccctgcagacgctgatcatgcttataggagcgctcaccttgatgggctacagttttgccgcggttggtgggatggaaggactgaaggagaagtacttcttggccctggctagcaaccggagtgagaacagcagctgcgggctgccccgggaagatgccttccatattttccgagatccgctgacatctgatctcccgtggccgggggtcctatttggaatgtccatcccatccctctggtactggtgcacggatcaggtgattgtccagcggactctggctgccaagaacctgtcccatgccaaaggaggtgctctgatggctgcatacctgaaggtgctgcccctcttcataatggtgttccctgggatggtcagccgcatcctcttcccagatcaagtggcctgtgcagatccagagatctgccagaagatctgcagcaacccctcaggctgttcggacatcgcgtatcccaaactcgtgctggaactcctgcccacagggctccgtgggctgatgatggctgtgatggtggcggctctcatgtcctccctcacctccatctttaacagtgccagcaccatcttcaccatggacctctggaatcacctccggcctcgggcatctgagaaggagctcatgattgtgggcagggtgtttgtgctgctgctggtcctggtctccatcctctggatccctgtggtccaggccagccagggcggccagctcttcatctatatccagtccatcagctcctacctgcagccgcctgtggcggtggtcttcatcatgggatgtttctggaagaggaccaatgaaaagggtgccttctggggcctgatctcgggcctgctcctgggcttggttaggctggtcctggactttatttacgtgcagcctcgatgcgaccagccagatgagcgcccggtcctggtgaagagcattcactacctctacttctccatgatcctgtccacggtcaccctcatcactgtctccaccgtgagctggttcacagagccaccctccaaggagatggtcagccacctgacctggtttactcgtcacgaccccgtggtccagaaggaacaagcaccaccagcagctcccttgtctcttaccctctctcagaacgggatgccagaggccagcagcagcagcagcgtccagttcgagatggttcaagaaaacacgtctaaaacccacagctgtgacatgaccccaaagcagtccaaagtggtgaaggccatcctgtggctctgtggaatacaggagaagggcaaggaagagctcccggccagagcagaagccatcatagtttccctggaagaaaaccccttggtgaagaccctcctggacgtcaacctcattttctgcgtgagctgcgccatctttatctggggctattttgcttagtgtggggtgaacccaggggtccaaactctgtttctcttcagtgctccatttttttaatgaaagaaaaaataataaagcttttgtttacc

SEQ ID NO: 6435 - DNA, 3272 bp, Homo sapiens
gaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacatgaggaaatcaaggtctggaggagacagagggatccatccaaggtcacacgggaggactggggtcaggtcccaggcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaattagtt

SEQ ID NO: 6436 - DNA, 1046 bp, Homo sapiens
gagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgggatcctgctggtggtgactgccgtctacaccattgcaggtggcctcatggccgtgatctacacagatgctctgcagacggtgatcatggtagggggagccctggtcctcatgtttctgggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatca

SEQ ID NO: 6437 - DNA, 3195 bp, Homo sapiens
atgaagccaggagcgcctcaaagtccagcctgctgttgaccaacactaacagatgagcaaggagctggcagcaatggggcctggagcttcaggggacggggtcaggactgagacagctccacacatagcactggactccagagttggtctgcacgcctacgacatcagcgtggtggtcatctactttgtcttcgtcattgctgtggggatctggtcgtccatccgtgcaagtcgagggaccattggcggctatttcctggccgggaggtccatgagctggtggccaattggagcatctctgatgtccagcaatgtgggcagtggcttgttcatcggcctggctgggacaggggctgccggaggccttgccgtaggtggcttcgagtggaacgcaacctggctgctcctggcccttggctgggtcttcgtccctgtgtacatcgcagcaggtgtggtcacaatgccgcagtatctgaagaagcgatttgggggccagaggatccaggtgtacatgtctgtcctgtctctcatcctctacatcttcaccaagatctcgactgacatcttctctggagccctcttcatccagatggcattgggctggaacctgtacctctccacagggatcctgctggtggtgactgccgtctacaccattgcaggtggcctcatggccgtgatctacacagatgctctgcagacggtgatcatggtagggggagccctggtcctcatgtttctgggctttcaggacgtgggctggtacccaggcctggagcagcggtacaggcaggccatccctaatgtcacagtccccaacaccacctgtcacctcccacggcccgatgctttccacattcttcgggaccctgtgagcggggacatcccttggccaggtctcattttcgggctcacagtgctggccacctggtgttggtgcacagaccaggtcattgtgcagcggtctctctcggccaagagtctgtctcatgccaagggaggctccgtgctggggggctacctgaagatcctccccatgttcttcatcgtcatgcctggcatgatcagccgggccctgttcccagacgaggtgggctgcgtggaccctgatgtctgccaaagaatctgtggggcccgagtgggatgttccaacattgcctaccctaagttggtcatggccctcatgcctgttggtctgcgggggctgatgattgccgtgatcatggccgctctcatgagctcactcacctccatcttcaacagcagcagcaccctgttcaccattgatgtgtggcagcgcttccgcaggaagtcaacagagcaggagctgatggtggtgggcagagtgtttgtggtgttcctggttgtcatcagcatcctctggatccccatcatccaaagctccaacagtgggcagctcttcgactacatccaggctgtcaccagttacctggccccacccatcaccgctctcttcctgctggccatcttctgcaagagggtcacagagcccggagctttctggggcctcgtgtttggcctgggagtggggcttctgcgtatgatcctggagttctcatacccagcgccagcctgtggggaggtggaccggaggccagcagtgctgaaggacttccactacctgtactttgcaatcctcctctgcgggctcactgccatcgtcattgtcattgtcagcctctgtacaactcccatccctgaggaacagctcacacgcctcacatggtggactcggaactgccccctctctgagctggagaaggaggcccacgagagcacaccggagatatccgagaggccagccggggagtgccctgcaggaggtggagcggcagagaactcgagcctgggccaggagcagcctgaagccccaagcaggtcctggggaaagttgctctggagctggttctgtgggctctctggaacaccggagcaggccctgagcccagcagagaaggctgcgctagaacagaagctgacaagcattgaggaggagccactctggagacatgtctgcaacatcaatgctgtccttttgctggccatcaacatcttcctctggggctattttgcgtgattccacagacctggcttcagtgtagacagattaaacaaagcccaagcctgtcagccacagaaacaggctctcctcttactttgctgtctaaactggagatcacagaagtcaagactgcaagctcccctgaagagaatccaactcaacctgcacacttgacaagtggagaaacagaagcccagagagagcactgggtttgttcaggaccacccagaaggtgtcacacggggtttccccactctttctgatatattgccttacagacctacctcaaacacactgtttccaccctcttcttgaatgtattcagtagcctttactgaatgtgtgtcttgagagtagaaaaatggaggatacaagaaaaggagcaggaagaaatttgcaaaaatccaagagcacctttgctcccccttatcctccttcctcttcccctttctagttcccctacctctctatctttctattctcaccaataatctctttgttgcatgaatttacccaggagagtcctatatttccattggtggctccacagtggtggctgtcagacccgaaggggtggggagccaagggtggactttaagcatggtgacagatggtattttgggcagaaagctcttagacaatggactatccaaagcactatttaaattctgcctcttcctactctctaacccaaatatgcacaaactctctatggccttgagaagcagttggagagacatgacttgttaaaacctcaaggaatcaagacatgttactctgtatttaagggtaagccccacagcgggcagcacaaacagcctgggagccactgtgcctgtgcttctctgtccttctccctttgcttgccatgaatccgcataccttggaatacactgtgaccccagttaagtgtcccttcgccaggaagctgccgcaacgtccagacctgggtcaagttcccactcctgctcccatagccttgacctgcttctgtcacagcactgatcacactgagatggaagactccagggggcaaggaccaagggccatatcccaagtgactttgtacccagaaaataacagctgttcaataaatgtgtattgagttaatt

SEQ ID NO: 6438 - DNA, 1046 bp, Homo sapiens; identical to SEQ ID NO: 6436

SEQ ID NO: 6439 - DNA, 3231 bp, Homo sapiens
gcgtggcctaagcggcccggtccagtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcattgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggctccagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtgatgttgactcaggaccccgcctctgtcctcactgtgccaggccatagccagaggccaccctgtagtacagggatgagtcttggtgtgttctgcagggacaggcctggatgatctagctcataccaaaggaccttgttctgagaggttcttgcctgcaggagaagctgtcacatctcaagcatgtgaggcaccgtttttctcgtcgcttgccaatctgttttttaaaggatcaggctcgtagggagcaggatcatgccagaaatagggatggaagtgcatcctctgggaaaaagataatggcttctgattcaacatagccatagtcctttgaagtaagtggctagaaacagcactctggttataattgccccagggcctgattcaggactgactctccaccataaaactggaagctgcttcccctgtagtccccatttcagtaccagttctgccagccacagtgagcccctattattactttcagattgtctgtgacactcaagcccctctcatttttatctgtctacctccattctgaagagggaggttttggtgtccctggtcctctgggaatagaagatccatttgtctttgtgtagagcaagcacgttttccacctcactgtctccatcctccacctctgagatggacacttaagagacggggcaaatgtggatccaagaaaccagggccatgaccgggtccactgtggagcagccatctatctacctgactcctgagccaggctgccgtggtgtcatttctgtcatccgtgctctgtttccttttggagtttcttctccacattatctttgttcctggggaataaaaactaccattggacctagaa

SEQ ID NO: 6440 - DNA, 732 bp, Homo sapiens
gtgggtctgagatcttaagtgcgagcggtaaggtggtggtctccgccgcgtagagggaagcgggaaaccgagaaagaacgagggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtga

SEQ ID NO: 6441 - DNA, 2230 bp, Homo sapiens
tccgccgcgtagagggaagcgggaaaccgagaaagaacgagggaaaagggagcgatgttgatctcaggaagcacaaagggaccttcctagctctgactgaaccacggagctactcatagagccagatcctcagctctgcagctccaggcaactctgcctcagaacagggattgcttctccagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcattgtggggtcagccaaggtgggcggcttggggcgtgtgtgggccgtggcttcccagcacggccgcatctctgggtttgagctggatccagacccctttgtgcggcacaccttctggaccttggccttcgggggtgtcttcatgatgctctccttatacggggtgaaccaggctcaggtgcagcggtacctcagttcccgcacggagaaggctgctgtgctctcctgttatgcagtgttccccttccagcaggtgtccctctgcgtgggctgcctcattggcctggtcatgttcgcgtattaccaggagtatcccatgagcattcagcaggctcaggcagccccagaccagttcgtcctgtactttgtgatggatctcctgaagggcctgccaggcctgccagggctcttcattgcctgcctcttcagcggctctctcagcactatatcctctgcttttaattcattggcaactgttacgatggaagacctgattcgaccttggttccctgagttctctgaagcccgggccatcatgctttccagaggccttgcctttggctatgggctgctttgtctaggaatggcctatatttcctcccagatgggacctgtgctgcaggcagcaatcagcatctttggcatggttgggggaccgctgctgggactcttctgccttggaatgttctttccatgtgctaaccctcctggtgctgttgtgggcctgttggctgggctcgtcatggccttctggattggcatcgggagcatcgtgaccagcatgggctccagcatgccaccctctccctctaatgggtccagcttctccctgcccaccaatctaaccgttgccactgtgaccacactgatgcccttgactaccttctccaagcccacagggctgcagcggttctattccttgtcttacttatggtacagtgctcacaactccaccacagtgattgtggtgggcctgattgtcagtctactcactgggagaatgcgaggccggtccctgaaccctgcaaccatttacccagtgttgccaaagctcctgtccctccttccgttgtcctgtcagaagcggctccactgcaggagctacggccaggaccacctcgacactggcctgtttcctgagaagccgaggaatggtgtgctgggggacagcagagacaaggaggccatggccctggatggcacagcctatcaggggagcagctccacctgcatcctccaggagacctccctgtga

SEQ ID NO: 6442 - DNA, 917 bp, Homo sapiens
atccgccctcagtaaacatggcggcacggcgagcggggcgggcagggggcgggcagggggcggggcccccgcgggctcccggccagggctctcggccgggctctggctacccacgtgtggagaccgggcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatggtgatctacatgggagttgtgctctatgctccgtcattggctctcaatgcagtgactggctttgatctgtggctgtccgtgctggccctgggcattgtctgtaccgtctatacagctctg

SEQ ID NO: 6443 - DNA, 741 bp, Homo sapiens
gtcgccctggggctgcttgggggcttttcctgctcgtggagctctgcgctggtcttcatgcgccctagccctctttcggggatactggccgaccccctcttccttttcccctttagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagccgctcttcctgcgtctgctgttgactgtgatgttgcaggtagaggggctgagagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccacctt

SEQ ID NO: 6444 - DNA, 676 bp, Homo sapiens
gagcgtgagccggtgccgagaggcaccggggagcggcgtctgagccggggcggggacaagggggcggggaggggcggagcgagccggcctccggcgtgggtctgagatcttaagtgcgagcggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacat

SEQ ID NO: 6445 - DNA, 570 bp, Homo sapiens
acgcacggctggccagcgaccctgcttcagcccgacctcaaacttgcttctgtacctcggtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagct

SEQ ID NO: 6446 - DNA, 599 bp, Homo sapiens
atatggcgttcgtgcgtagagagattacacaagaggcagaggacccgtctgtagaaagaacttaaagttattctaaaattaaggggcgaaatcaagtttcacaggtctttgaaagtcggcaggactggggcgccgaaggcctgcacgactgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctc

SEQ ID NO: 6447 - DNA, 725 bp, Homo sapiens
atatcgcacagggaaggtcctcatctctgaagatcactattcgaacttatttattatgctttctgcagagacttctcaatctgacagccctagtttggcgcggtgtaaaacgaccgcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctg

SEQ ID NO: 6448 - DNA, 542 bp, Homo sapiens
agtaccagatatcgcacagggaaggtcctcatctctgaagatcactattcgaacttatttattatgctttctgcagagacttctcaatctgacagccctagtttggcgcggtgtaaaacgaccgcagtgaaggcctcccccgtcgccgcgcggcttcccggagccgactgcagactccctcagcccggtgttccccgcgtccggacgccgaggtcgcggcttcgcagaaactcgggcccctccatccgccctcagaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatg

SEQ ID NO: 6449 - DNA, 871 bp, Homo sapiens
cggccgggctctggctacccacgtgtggagaccgggcaggaaaagggagcgatgttgatctcaggaagcacaaagggaccttcctagctctgactgaaccacggagctcaccctggacagtatcactccgtggaggaagactgtgagactgtggctggaagccagattgtagccacacatccgcccctgccctaccccagagccctggagcagcaactggctgcagatcacagacacagtgaggatatgagtgtaggggtgagcacctcagcccctctttccccaacctcgggcacaagcgtgggcatgtctaccttctccatcatggactatgtggtgttcgtcctgctgctggttctctctcttgccattgggctctaccatgcttgtcgtggctggggccggcatactgttggtgagctgctgatggcggaccgcaaaatgggctgccttccggtggcactgtccctgctggccaccttccagtcagccgtggccatcctgggtgtgccgtcagagatctaccgatttgggacccaatattggttcctgggctgctgctactttctggggctgctgatacctgcacacatcttcatccccgttttctaccgcctgcatctcaccagtgcctatgagtacctggagcttcgattcaataaaactgtgcgagtgtgtggaactgtgaccttcatctttcagatgtgactggctttgatctgtggctgtccgtgctggccctgggcattgtctgtaccgtctatacagctctgggtgggctgaaggccgtcatctggacagatgtgttccagacactggtcatgttcctcgggcagctggcagttatcattgtggggtcagccaaggtggg

SEQ ID NO: 6450 - DNA, 2155 bp, Homo sapiens
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctg

SEQ ID NO: 6451 - DNA, 2185 bp, Homo sapiens
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgccttcttcatcccctacctcgtcttcctctttacctgtggcattcctgtcttccttctggagacagcactaggccagtacactagccagggaggcgtcacagcctggaggaagatctgccccatctttgagggcattggctatgcctcccagatgatcgtcatcctcctcaacgtctactacatcattgtgttggcctgggccctgttctacctcttcagcagcttcaccatcgacctgccctggggcggctgctaccatgagtggaacacagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgc

SEQ ID NO: 6452 - DNA, 1101 bp, Homo sapiens
agataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggaggtgagatgagagcccttgtgccaccccacccactcctggaaggaggatacttccatctcctgcacttacggcccctctggggagtcccatagatgtatagaattctggaggtaggaggacgcttagaggtcattaaggacactctgtaagagactaagacctagaaaggttacgtgactatcccagggctctttctattataacgtggcatcgtagaaatatgagcacaagctggaaccaggtggatgagagtttggattctggctctgctacttaacactctgtgtgatcttggacaagttacttaagctctcagagcatcaattgccgctcctgcaaattgagataataatgcctgcctttcaaggtcattgtaaggattagagacaatgtgtgtaaagcacttaataaatagtagctctgctgatgatgacgttgataaccaaactgttctgtggtcttaagtaataaatagtagctctgctgatgatgacgttgataaccaaactgttctgtggtcttaagtaataagtagtagctctgttgatgatgacgttgataaccaaactgttctgtggtcttaagtaataagtagtagctctgctgatgatgacgttgataaccaaactgttctgtggtcttaagtaataaatagtagctctgctgatgatgatgttgataaccaaactgttctgtggtcttaagtaataaatagtagctctgctgatgatgacgttgataaccaaactgttctgtggtcttaagtaataaatagtagctctgctgatgatgacgttgataaccaaactgttctgtggtcttaagtaataaatagtagctctgctg

SEQ ID NO: 6453 - DNA, 1948 bp, Homo sapiens
cacactttaaatagccagcaccttctccttcccccttagataattcttctcccctgactggacctctggcagcagcttcactaaggtgggatggatagcagggtctcaggcacaaccagtaatggagagacaaaaccagtgtatccagtcatggaaaagaaggaggaagatggcaccctggagcgggggcactggaacaacaagatggagtttgtgctgtcagtggctggggagatcattggcttaggcaacgtctggaggtttccctatctctgctacaaaaatgggggagaacactgtatggagttccagaagaccaacggctccctgaatggtacctctgagaatgccacctctcctgtcatcgagttctgggagcggcgggtcttgaagatctctgatgggatccagcacctgggggccctgcgctgggagctggctctgtgcctcctgctggcctgggtcatctgctacttctgcatctggaagggggtgaagtccacaggcaaggtggtgtacttcacggccacatttccttacctcatgctggtggtcctgttaattcgaggggtgacgttgcctggggcagcccaaggaattcagttttacctgtacccaaacctcacgcgtctgtgggatccccaggtgtggatggatgcaggcacccagatattcttctccttcgccatctgtcttgggtgcctgacagccctgggcagctacaacaagtaccacaacaactgctacagggactgcatcgccctctgcttcctcaacagcggcaccagctttgtggccggctttgccatcttctccatcctgggcttcatgtctcaggagcagggggtgcccatttctgaggtggccgagtcaggccctggcctggctttcatcgcttacccgcgggctgtggtgatgctgcccttctctcctctctgggcctgctgtttcttcttcatggtcgttctcctgggactggatagccagtttgtgtgtgtagaaagcctggtgacagcgctggtggacatgtaccctcacgtgttccgcaagaagaaccggagggaagtcctcatccttggagtatctgtcgtctccttccttgtggggctgatcatgctcacagagggcggaatgtacgtgttccagctctttgactactatgcggccagtggcatgtgcctcctgttcgtggccatcttcgagtccctctgtgtggcttgggtttacggagccaagcgcttctacgacaacatcgaagacatgattgggtacaggccatggcctcttatcaaatactgttggctcttcctcacaccagctgtgtgcacagccacctttctcttctccctgataaagtacactccgctgacctacaacaagaagtacacgtacccgtggtggggcgatgccctgggctggctcctggctctgtcctccatggtctgcattcctgcctggagcctctacagactcggaaccctcaagggccccttcagagagagaatccgtcagctcatgtgcccagccgaggacctgccccagcggaacccagcaggaccctcggctcccgccacccccaggacctcactgctcagactcacagagctagagtctcactgctagggggcaggcccttggatggtgcctgtgtgcctggccttggggatggctgtggagggaacgtggcagaagcagccccatgtgcttccctgcccccgacctggagtggataagacaagaggggtattttggagtccacctgctgagctggaggcctcccactgcaacttttcagctcaggggttgttgaacagatgtgaaaggccagtgccaagagtgtccctctgagacccttgggaagctgggtgggggctggtaggtggggcgagacttgctggcttcgggccctctcatccttcattccattaaatccacattcttcccgctg

SEQ ID NO: 6454 - DNA, 4044 bp, Homo sapiens
gtaacacgggcgggccgagcacgtgggcgcctccgtcacaccctcacacatacacacacgcgcgcgcgcacacacacatacgcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagtttaaaaatgatgtttgtttttcacattgattttctttgtatcacctgaactggattgtctttcatttcagtcagcacttagacatttcataataactaaacatcacattccaagtgggatgaattacattaattgaatagagttaccaccgcttcagagtctaaggaaaaatagagtattatggttcaatggtgttcttatgtagtcttatgattcttgaaaaagtacttacagcctcccaagaaaccatgtgtacaattgactgcttgctgattcaatattgtctgcaaagtataaaagactatgatttttaaataaaactgttgtatatatgaaa

SEQ ID NO: 6455 - DNA, 2345 bp, Homo sapiens
tttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatattgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttttaccaatgaacattggccctagtaggagaagcattaggcttcacttatcagagggcaatctcaggtgttccgtggctgtgatctttaatcctaacagtatatgtcagttcaacttgagcattcttttggattctttggtttacatttgtgcagaaaggattgcagacaaatcttaggagggctgaggtacatgtttgccaggatttttttttaagtacctttggtgtattttcaaatatttctatctcttaaaaaaatggtattacctcagtttctaataatttctgggtttagtagtgttgacaattaaaaatggtatacattaaaatttataagtttgccttcagggtaacttccagtgtcacaatgagcagttctgtaagtgggtgcctctcagcacatttctatgaatatattatgtagataggctgtattgattttggtagcattgacaccttcttaggcaattagttgaagaaaactgcaaaatattttcttatgtaatagctgtatagagcaatagcaatcaaagcatgagaaggcactaacgctgggatgaaagatgagattcagaggtgactgagaatcatgtgagtgatggctgtatattttgtgtaaaatatatgtgtgaaaatgaactaagagtgagttactcagcactctcaagaattatgcagattctgcatttttcttatgccgtgtgcctaaaaacctacttgatatttattgtggtttcaagattattcatagtatatttatacaatatacttgcaatgcatttaagtacttaaagtactaatttgaaaacttgaagcaagatggcattttaattaatatatttctgttttgcttctgttttatgcaaatataaatcatttttaagtgattgttaaaattgtaatgcattacattttaatctacaaataaacaaagttt

SEQ ID NO: 6456 - DNA, 4168 bp, Homo sapiens
atgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggcggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaagttagtatgttagagcccttcctcattctgctaatcaccatttctggattcatccctctctcaaattctgttacagatttctgtgggcaaatcacacataacacttcattctaggtagttaaatattagtgaaaagtgacacttcaaaagtgtgcttacatttttaaaaagacaaataaaaacagtgttttatagtgaaatctaaggttaattataatctttccttatttcaacaagatctttaaaatttttgtgaatacttaaaagtcctttctttttgccctttattcaattagtcctaatgtttcagttctctaattaccaattagttaaattatggaaattggggaaagtggtaaaatgagtaattcattcattttgtttgtttgatatcatttgtttctctctgctgtaggtgttctaaggaatagctgcataagacattttgaaataatgtaatgtgaagtgtttcttaaagctctgaacatcattaagtagttaataataattccaacaaggaattcagagtaatgtaaaagactaaatatcattccttctaaggcaaattgaaaattagaatggttgtggtttaaaaagacattaagtgaattctaggtagcttgtttgttattatttttaaaggacgctctaggaaagtaattgctattcactattttgctttcgtattactttttttttttttttttcattatcacagccattgttctaaagctctccacatctcttggctggatcatagcaagaatttactgttggctcttctctctgccgtttaactgtccagctgtgctattttccttttcaaagtataactgatttcaggctaacttattaccactcatcatcatatactagcaggaatggcaatagtagtagtagtagcagcagcaatagtagaagtagtcataataacaataataataaatgatgataaagatgtttctgacaagaattagggtaagaacagtaattgaagccaattatttattacaaatgtattttgctttgggtactgtgataactactttttatactttatcccatttaattataaaaaccactcttgagaagtaatttttattttcagaaccattttacagatttaaaataaacaggtttgaggaattagtttaacttatccaaagtttcgtggctattaagttctagtatttggagtcaaatgcaagtctgtctaaatctagagcccatgttctttaactgcaacactataatgtctcaccccgtcctagtcccaccaattagtcaactcttttagggcagaagtctgtctaattcatctttgcttcctgttactttatatttaattaaaaattttagtgactttttaacttgtaaattgtagctgattttacatttatcttcctgaaggaaactctgtatcattttgtcttttgaatttgtgaatatacttgttaacacatctaaatatctttaagtctttggcaatgttattgtattatatgactaaataacttcgaattgttcaattgtgtatgtcttccactatgtcagagccacattcccgtcacattataaatgaaggagtggattcttaaataagacctaaccatatttatatgattcctaacataatatcatttggtagaaagaaaaccaactgtggtcatccagagaagctcaaaaactcttgtactcaggttctcttactaccacgttttgtttctgtttcttcttagtctgtgtcttagcatcacttaaagaactattcatccttttcttatcacagaatcttggggttgttcttctcatgtcatgtagtgtaaatttatatagaaaatgtaatacaatttatttagtacatacatttattattttaatgagaatgcctcaggaaaagactagtatttgggcaatatttgaagaaagaatttaacaggcactgatggggagaaagctagctgtaggtaatgtgagcaaagatgtggaagccaaaattgtcacaattcctcaatctgaaacaatgagttaaatataataacaatgactttatgaggaattaaaggttaagctttgtgtttacctactaaacagaaaatgcctccaaataaacagtgtcacaagtacagaagagagaaatattgtttaaggctagcacatggaaaaacaacttagaggatttagcagctaaaagaagaatgagtcagctggtgatgtgcttggtcaaaacacacagtcatacatgcatatacatataccccaaaatgctaagtggaaactgcatgaattaaaagaggggtatgatagggacattgtcctttgggctaggtaggcacatatcagttggaccacatctgcaatactggattttactgaaatcttgtattttcctttttattatgagaaatttcagctcagtgatcaaagtcttcaaatagttaaaccaaaagaagaatagggctgctttgtgtggccatagagagcaaaactatgatcaaatagtgggtattatggaggaggttgtgatggtggtaagccttcaaagaaagaaaggcctttcaagaatcaaacttgataataatgaaatcagttgcctcaatggtagagagctcagcatcactggaggtggtcacacagaggtagcatgtgccctagttacagaatctattaaggggatgactgtctcaaatatgtaggacagaaatgagaagccccaagcttgcttttaactctaaggtagtattttctactctgactactttcctgttgttactactactatgctaaatactatgcatacattatcttgtttattctttctatcagctagataatttgcatattttatccccattttactgcaaagttgacaagctcagggaaaataaatagttggccagaattaagcaaccaatacatgatagacagggctaaaactgggctacagaatttt

SEQ ID NO: 6457 - DNA, 563 bp, Homo sapiens
attcgcttccgttcgctttagcaaaggcagaaggcgactaccgaggacagagtgttttcacgtgaccacagttcccctttgcttgaggtacctacagaatactggacatacggattcagaatccataaggctttatcaccttgaatcaaggatttatttgatatcatcctcggtctttacttcctatcaagtaacattgttttgaaaaatagagttaacacatttgccataagggagtttttttttttttttttaaatacttcgcatactctccaatgcccaaaaatagcaaggtggtaaaaagagaattagatgatgatgttactgagtctgtcaaagaccttctttccaatgaagacgcagctgatgatgcttttaagacaagtgaactaattgttgatggccaggaagagaaagatacagatgttgaagaaggatctgaagtcgaagatgaaagaccagcttggaacagtaaactacaatacatcctggcccaagttggattttctgtaggtttaggaaatgtgtggcgatttccatacctatgtcagaagaatgggggc

SEQ ID NO: 6458 - DNA, 2221 bp, Homo sapiens
acatacgcatgtacacgcgcacccgcacccgcgcgcctgtatcccgtgctgtttccctggcagacacacaggcgctcacgagtctctccttgccagcctgcagggcggcgacccccaaaacccagctccgggtcccaacctaggcaagaagctgcttctctgccaacagctcctcttcggcctccgtcacagccacctggaccctaccctttcgcgactgctgctgctgctgcccggacgtggaagcagcaagaggcgcttggtcaagacacactgacggtgcatatcttttaccatatttaatactacttatggtaataggtattcccctttttttcttggaactctctgtgggtcaaagaattcggcgaggcagcattggtgtatggaattacataagccctaaactgggcgggattggatttgcaagttgtgtagtgtgctattttgtagctctctactacaacgtcatcattggctggagtttgttttatttttctcagtcttttcagcaacccctgccttgggatcagtgtcctttggtgaaaaatgcttcacacacttttgtagaaccagaatgtgaacaaagttctgccaccacctattactggtacagggaagcactgaatatttcaagttccatttctgaaagtgggggcttaaactggaagatgaccatctgcttgttggctgcctgggtcatggtttgcttggctatgatcaaaggcattcagtcttctggaaaaatcatatattttagttctctgtttccatatgtggtacttatttgcttcctcatcagagcattccttttaaatggttcaattgatggcattcgccacatgtttacccctaagcttgaaataatgctggagcccaaggtctggagagaagctgctactcaagtgttctttgccttaggtctgggatttggtggtgtcattgccttttcaagctacaacaagagagacaacaactgccactttgatgctgtcctggtgtccttcatcaattttttcacttctgtcctggcaacattggtggtgtttgcagttctgggcttcaaagcaaatgtcataaatgagaaatgcattacacaaaattcagagacgatcatgaaatttttgaaaatggggaacattagtcaggatattattccccatcatatcaacctttcaactgttactgcagaagattatcatttagtttatgacatcattcaaaaagtgaaagaagaagagtttcctgctcttcatctcaattcctgtaaaattgaagaagagctaaataaagctgttcaggggaccggcttagcttttattgcctttacagaagcgatgacacattttcctgcatctcccttctggtcagtgatgtttttcctcatgctggtcaatctaggccttggcagtatgtttggaaccattgaagggattgtcacgcctattgtggacactttcaaagtgaggaaagaaattcttactgttatctgttgtcttctggcattttgtattggcctgatatttgtgcaacgctctggaaattactttgttacaatgtttgatgattattctgctacactgcctctgctaattgtagtcattttggagaatattgctgtatgctttgtttatggcatagataagtttatggaagacctaaaagatatgctgggctttgctcccagcagatattactactatatgtggaaatatatttctcctctaatgctattatcattgctaatagctagtgttgtgaatatgggattaagtcctcctggctataacgcatggattgaagataaggcatctgaagaatttctgagctatccaacatggggactggttgtttgtgtctctctggttgtctttgcaatactcccagtccctgtagttttcattgttcgtcgcttcaaccttatagatgatagttctggtaatttagcatctgtgacctataagagaggaagggtcctgaaagagcctgtgaacttagagggcgatgatacaagcctcattcacggaaaaataccgagcgagatgccatctccaaattttggtaaaaatatttatcgaaaacagagtggatccccaactctggatactgctcccaatggacggtatggaatagggtacttgatggcagatattatgccagatatgccagaatctgatttgtagctgggggaaaagtcagtgggttttatttggttcatttt

SEQ ID NO: 6459 - DNA, 2928 bp, Homo sapiens
tcggcgggaaaggccgcgcgccaggcagatcgaggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcacctcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactccaaggactggatgtaagcagatctttttttcctatagatgtctcagatgttcagttttcctgtcacaaggcttccagtctgtattagttcattttcacactgctaataaagacatacctgaaactggg

SEQ ID NO: 6460 - DNA, 2981 bp, Homo sapiens
aggggtgtcgcccaaaccgatctgtcgacgcctgaaggggcctgaggagattgctaggcttctcagctggggcttcttcaccctcatttttgtccgactggctggactgaagaacctggcagaagccttggggctagggtctcctcaggaagatgaaccctcccttgcagaagcgggagctgccccagagagtctgtgtgagatgaagacagaggcccagccttcgacatccttgctggcaaacacctcatggactggcacagtgatttctgacagtgtcccaggaagtcaaacgtgggaagacaagggttcattgacccggtctgcaacatcttggacctcagaggcccaagtttcagcagcccgggttgcagaggctcaggccaggaccagtcagcccaagcaaatttctgtattggaggcgttaactgcctcagccctgaaccagaaacccacgcatgagaaggtgcagatgacagagaagaaagagagtgaggtcctccttgcccgtccgttctggtccagcaaaactgagtatattctggctcaggtgggcttctctatgaagccatcttgtctctggcgctttgcctacctgtggcttaacagtggaggctgcagtttcgctgccatctacatcttcatgctgttcctggtcggggttcctcttctcttcctggagatggcagctggtcagagcatgcgtcagggtggcatgggtgtatggaagatcattgccccctggattggtggtgtggggtattctagcttcatggtgtgcttcatcctcggcctgtacttcaatgtggtcaattcctggatcatcttctacatgagccagtccttccagtttcccgttccatgggagaaatgtcccttaacgatgaactctagtggctttgatcctgaatgtgaacggacaacaccctccatatacttctggtaccagcaggccttgaaggcctcagacagaatcgaggatggcgggtcaccagtctacagtctggtcctgcccttctttctttgctggtgtcttgttggtgctttcatgatcaatgggctcaagtccactgggaaggtaatctatgtcttggtactgctcccctgtttcatcattgtcggtttcttcatccggactctactcctggaaggggcaaaatttggccttcaacagttggtggttgccaagatatcggatgtgtacaatatgagtgtgtggtctctagcagggggtcaagttttgtctaacacaggcataggccttggctccgttgcctccttagcctcctacatgccccagtccaacaactgtctcagtgatgcctttctcgtgtctgtgataaacctgctcactttgttggttttcacatctttcaacttctgtgtcctgggcttctgggcgacagtcatcacacatcgctgctgtgagaggaatgctgaaatacttttaaagctgataaacctagggaaactgcctcctgatgccaagccccctgtcaacctgctttacaacccaacctccatctacaatgcctggctcagtggccttccccagcacatcaaaagcatggttctccgcgaggtgactgagtgcaacatagagactcagtttcttaaggctagcgagggcccaaagtttgcattcctgtcctttgttgaagccatgtccttccttcctccgtctgtcttctggtcttttatcttcttcctgatgttgctggccatggggctgagcagcgcaatagggattatgcagggcatcattactccactccaggacaccttctctttcttcaggaaacatacaaagctgctcatagtgggagtctttttgctcatgttcgtgtgcggcctcttcttcactcgaccttcaggcagctacttcatcagactgctgagtgactactggatagtcttccccatcatcgtcgttgtcgtatttgaaaccatggctgtatcctgggcctatggggccaggaggttccttgcagacctgacgatcctgttgggccaccccatctctcccatctttggttggctgtggccccatctgtgtccagttgtgctgctaatcatctttgtgaccatgatggttcatctttgtatgaagccgatcacctacatgtcctgggactcaagcaccgtgagcctcccccaggacccagaacccctttgggagtaggggccagacctttcaattcactctgggtgaaagaacccagtcatctcattctcttactgcccgaagactcatgggttttctgctttggttccccacccatccttcccctccacaactcttccttttctcttggggattttgatattctgaacccttttcccatctctccacagtcaaaagaggtgcttcgaccatacccaccgtgggcactgctcttgatgatcaccctttttgccattgtcatcctccccatccctgcatactttgtatactgccgcatacataggattcccttcaggcccaagagcggagacgggcctatgacagcctccacatccctacccctaagtcaccagctaacacccagtaaagaggttcaaaaggaagaaattctacaagttgatgaaacaaagtacccatcaacttgtaatgtgacttcctaacttcattaatttggcttcacataacatatcccttagaacagatccaatagacaactcttaatatcagcttgcaactgttgatctccctggatccagaaccacttttatttccaagaggaggggcattctttgggggtgttcatggggcctggacttgcaatcccttcctgggtcccatcttacctggtgaccaccatcattgttttccccatcctcttcctcaacacacatacatgcacaacacatatacaatactagtgatgtctaccagtcctgctacttctggggtgcctgtctcctggaatggagctggaggagcaatgctgttggtgaataaatcagtctactggaactcc

SEQ ID NO: 6461 - DNA, 6420 bp, Homo sapiens
agggtggcctttcggaaagcgagggaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtccctgaatgagaaggagctgacagcagctgaattccatcttctctgtgtgctggggagcagggctacacggcccaggtggcatcaatgccgaagaacagcaaagtgacccagcgtgagcacagcagtgagcatgtcactgagtccgtggccgacctgctggccctcgaggagcctgtggactataagcagagtgtactgaatgtggctggtgaggcaggcggcaagcagaaggcggtggaggaggagctggatgcagaggaccggccggcctggaacagtaagctgcagtacatcctggcccagattggcttctctgtgggcctcggcaacatctggaggttcccctacctgtgccagaaaaatggaggaggtgcttacctggtgccctacctggtgctgctgatcatcatcgggatccccctcttcttcctggagctggctgtgggtcagaggatccgccgcggcagcatcggtgtgtggcactatatatgtccccgcctggggggcatcggcttctccagctgcatagtctgtctctttgtggggctgtattataatgtgatcatcgggtggagcatcttctatttcttcaagtccttccagtacccgctgccctggagtgaatgtcctgtcgtcaggaatgggagcgtggcagtggtggaggcagagtgtgaaaagagctcagccactacctacttctggtaccgagaggccttggacatctctgactccatctcggagagtgggggcctcaactggaagatgaccctgtgcctcctcgtggcctggagcatcgtggggatggctgtcgttaagggcatccagtcctcggggaaggtgatgtatttcagctccctcttcccctacgtggtgctggcctgcttcctggtccgggggctgttgctgcgaggggcagttgatggcatcctacacatgttcactcccaagctggacaagatgctggacccccaggtgtggcgggaggcagctacccaggtcttctttgccttgggcctgggctttggtggtgtcattgccttctccagctacaataagcaggacaacaactgccacttcgatgccgccctggtgtccttcatcaacttcttcacgtcagtgttggccaccctcgtggtgtttgctgtgctgggcttcaaggccaacatcatgaatgagaagtgtgtggtcgagaatgctgagaaaatcctagggtaccttaacaccaacgtcctgagccgggacctcatcccaccccacgtcaacttctcccacctgaccacaaaggactacatggagatgtacaatgtcatcatgaccgtgaaggaggaccagttctcagccctgggccttgacccctgccttctggaggacgagctggacaagtccgtgcagggcacaggcctggccttcatcgccttcactgaggccatgacgcacttccccgcctccccgttctggtccgtcatgttcttcttgatgcttatcaacctgggcctgggcagcatgatcgggaccatggcaggcatcaccacgcccatcatcgacaccttcaaggtgcccaaggagatgttcacagtgggctgctgtgtctttgcattcctcgtggggctgttgttcgtccagcgctccggaaactactttgtcaccatgttcgatgactactcggccaccctgccactcactctcatcgtcatccttgagaacatcgctgtggcctggatttatggaaccaagaagttcatgcaggagctgacggagatgctgggcttccgcccctaccgcttctatttctacatgtggaagttcgtgtctccactatgcatggctgtgctcaccacagccagcatcatccagctgggggtcacgcccccgggctacagcgcctggatcaaggaggaggctgccgagcgctacctgtatttccccaactgggccatggcactcctgatcaccctcatcgtcgtggcgacgctgcccatccctgtggtgttcgtcctgcggcacttccacctgctctctgatggctccaacaccctctccgtgtcctacaagaagggccgcatgatgaaggacatctccaacctggaggagaacgatgagacccgcttcatcctcagcaaggtgcccagtgaggcaccttcccccatgcccactcaccgttcctatctggggcccggcagcacatcacccctggagaccagcggtaaccccaatggacgctatgggagcggctacctgctggccagcacccctgagtcggagctgtgaccactgcccaagccctgcccgcctctccccccacgctcaacctgcccacttgtccaggcctggcctctttcttgaggtggccaccaggcccaggccaggccctttgcccaagaagagagggtctgccctgcctcactcccctcttcagtcccagtagactctgctccctagccctgagcaggaggctgggagcagctctgtttcctaattcaggaccccactcatctagccctccaagagcctccgccaaattgtagccatgtaattggaacaacccataaggcctgcttcccagtccatgggagattccaagtggccactgcaggagtcactcacctccctctctccctgtaacttgccacctgcagttcttagggctgtggggtcagatggtggtggtgagaggccttggggctggggaaggagagtggactttggctcactctgccatgagaacaggacaccatcctgcccagcccagacggggttgctcctggtccaagaggctacctgctccaaggcggagggtgggagcaggtgtgccagggctcagggctcagacttgggagggcctaggcagaagccccaagttctgttttctgaggtatgtgctgcccttggcttcagcatgagccttggtagcagaaggtgaggaacctcctctgccctggtccctgggtggaatcttcccatgtccttggccctgcctggggtgtgtggtgtgtgctcctgcatcttgtctgggagtgcagtgaccgggaccagaaccttccccacctcaattagggcttagccatctccctgtccccagcacccctccccagcccacagtggtggcctctgcctctttcctggagagagaaggacagtgcacggagaggtttccagagcacaaattgttggttcctagcacaaattagatggtttggagcacaatggtgaagcacactcccctccctcctcacctggggtccaatgttctgtctagtggcagcttttcccctggaacaggggtccctggagttcacaggcttatccccaggaagcctcactcctggggaaagacagataatttcactgcccctttgagccaccactcactctccttattacacaagcacagccgcccagtgtgcacatcatgtgcagacaccttggaaacctttcccaagccttcctggcccacagtggccagtgccataggcagtgctgtggacagtagaggctgccaaaggcaagggctggtcttcaggatggaggccagcctgtgcagaaggctgcagctgacaacagcgaccccacctgccattaccttcagggcctcctctggaagagaacccattctcagagtgcagccagggaggaacctgacccaagagtaaatgtctgcagagagatggatggatggatggatagatggatggatgggttggggagtgggggtggatggatggatagatggatggatggatggatggatgggttggggggtgggggtggatggatagatggatggatggatggacggatggggtgggggaaggaaggaaaggagggagaaaggagggaatactggctccatctttgagagctctggtgggcagggcagaaacaggccacagtgctcaacccggacaccctcacgaagggtcgcaagtcactcttgtggctcagattgctcttaggacctggagggacagaccagaatcagggtcccctcctttacccctgagttccttactgttcccccaagcctgggagcagtctatcccccaaccctgccatctcccttactcatccctcttccacagcttcccctttctagccccctctgccctacctgtctttcctgagtgtttgaggggagagagagacccacatctccccaaagagatgagcttttggggcacaacatcccaccgcagtccccctcacccgacaacacctcctacctggccccttgccaaatcccaagcagaattagcaacaggaaaagcagagccccaggagagacactctactatatatactcttctatatattctgtttctattgtatattcactctgtacatgtgggtgtaaatgctgttaaatgacaaacccaatattatactgtggctggtggactattttcatcctcagtgctgtacagatctattttcattgtatatttgatatatttttaattttgtagcgtgtggctgggccaggccccagcgggaggggctgagctggggctgtgtgcttgctaggtgtgggcgcgctagtgctcgttgtagccttttgctgtgtcttcgctgtgtgttagacgtagggcctagagctcggggtgtgtgtgtgcgtgctgtgtgtatggtgtgcacatacgtgagtgtgggtgtgtgtagcgtgctgatctgtgactcccagtgttcaccaccttcctgaagaccacgctccctccccctgcctcctcctcctcctcttggctctattgggagcctcagggccggcagggtgcttcgggagccccctgctacggggaaaggcatgtgtttcttgctggtgactcattgccttcacaccactgggtttgccagaaacagggaaggagggcgttaagggaaaaaaaaaatcctcaaatttatttaccagtcagcttcttgctgttcccagtagaatcgctagctcttctccagaggaaaagtactaggattcttaagatggcgagaccccaagagggatctcatagcactgctgcatttgccgttgacgcagtcctgacagtgtttgaaaagggccgcctgccccctccccactgtgcttttgatgcctttggagtcaaaggcaggtggggtcacctgatgagctaagatccagccccagaatcctggaggagcaggaggtagcaggagaggaccaggtccccaagtcccttcacagggtccccacccccactggctttggtgctgtccacacagtgcccaccagaaggcagagggaactccagggcagggatgtgcctgaaagagtcaacagtcccctgatcccctacctctgcctgccctccagccccatcaccagcttcttgctcagggagacttccgccctcctcactgaggcaacatgaagcccgaggcccagatgggggctgaacaggtagggcacatcagttaatgccagtgaggtcagcttctgccctccagcaatacatgtgcaggggttgctgctttcccagtgccaggagaacccccgctccgagtcagcctgtgtgggtcatgaggctggggcccaggagacacggtcccaggcactgcacaggcctgcagtattaccaggcggaggggctgcttttctgcccttcctcacccccacgccccaccccactcccccagagtactccccactgtgaaaagagctggaaactaaactggttagaatgaacctggctccctgagcatccctggatccttcaaataggccctgagatgtgaggtctgctgcttcactggggcccgatgactttggctgggggagggggcctagggcctcttctcattgaaagctctgctttatacagacccaagcatacacaccaggccgtcactttgggttctggcataagttcagaacaattcaagtccatgtgtcccatggctggtcagagccctgggtcaaaaccactcagcccaggggaggggatgaggcattgtcaccctagacccctcttcctctctcccccaccatagtgtgcaataaagtgtctgttcttaccaaa

SEQ ID NO: 6462 - DNA, 6400 bp, Homo sapiens
gaacagtgcgcgcagcgctccgcccagctccgttctgctccgcagagccggcgctgccagggcgcagggagggcggcactcggccccagtcttcgcaatcccgcgcgctctctccgccgtgggacctgggtccccgcgccgctcccctgagccccgagcgcgcggcgggcgggagccaggttgggactggtggtgaggcagggagtgaggagcgagcggagtcgcgtgcgccggcgcgcagctccgggtcgccccagccccagccgggggcctgtggcccgggggaggagctgtgcgtccgcgacccgtcggggatcgcagctgctcggccggagtgcacgggccgagtctgcgcgactacccacgcgtgacaggtccctgaatgagaaggagctgacagcagctgaattccatcttctctgtgtgctggggagcagggctacacggcccaggtggcatcaatgccgaagaacagcaaagtgacccagcgtgagcacagcagtgagcatgtcactgagtccgtggccgacctgctggccctcgaggagcctgtggactataagcagagtgtactgaatgtggctggtgaggcaggcggcaagcagaaggcggtggaggaggagctggatgcagaggaccggccggcctggaacagtaagctgcagtacatcctggcccagattggcttctctgtgggcctcggcaacatctggaggttcccctacctgtgccagaaaaatggaggaggtgcttacctggtgccctacctggtgctgctgatcatcatcgggatccccctcttcttcctggagctggctgtgggtcagaggatccgccgcggcagcatcggtgtgtggcactatatatgtccccgcctggggggcatcggcttctccagctgcatagtctgtctctttgtggggctgtattataatgtgatcatcgggtggagcatcttctatttcttcaagtccttccagtacccgctgccctggagtgaatgtcctgtcgtcaggaatgggagcgtggcagtggtggaggcagagtgtgaaaagagctcagccactacctacttctggtaccgagaggccttggacatctctgactccatctcggagagtgggggcctcaactggaagatgaccctgtgcctcctcgtggcctggagcatcgtggggatggctgtcgttaagggcatccagtcctcggggaaggtgatgtatttcagctccctcttcccctacgtggtgctggcctgcttcctggtccgggggctgttgctgcgaggggcagttgatggcatcctacacatgttcactcccaagctggacaagatgctggacccccaggtgtggcgggaggcagctacccaggtcttctttgccttgggcctgggctttggtggtgtcattgccttctccagctacaataagcaggacaacaactgccacttcgatgccgccctggtgtccttcatcaacttcttcacgtcagtgttggccaccctcgtggtgtttgctgtgctgggcttcaaggccaacatcatgaatgagaagtgtgtggtcgagaatgctgagaaaatcctagggtaccttaacaccaacgtcctgagccgggacctcatcccaccccacgtcaacttctcccacctgaccacaaaggactacatggagatgtacaatgtcatcatgaccgtgaaggaggaccagttctcagccctgggccttgacccctgccttctggaggacgagctggacaagtccgtgcagggcacaggcctggccttcatcgccttcactgaggccatgacgcacttccccgcctccccgttctggtccgtcatgttcttcttgatgcttatcaacctgggcctgggcagcatgatcgggaccatggcaggcatcaccacgcccatcatcgacaccttcaaggtgcccaaggagatgttcacagtgggctgctgtgtctttgcattcctcgtggggctgttgttcgtccagcgctccggaaactactttgtcaccatgttcgatgactactcggccaccctgccactcactctcatcgtcatccttgagaacatcgctgtggcctggatttatggaaccaagaagttcatgcaggagctgacggagatgctgggcttccgcccctaccgcttctatttctacatgtggaagttcgtgtctccactatgcatggctgtgctcaccacagccagcatcatccagctgggggtcacgcccccgggctacagcgcctggatcaaggaggaggctgccgagcgctacctgtatttccccaactgggccatggcactcctgatcaccctcatcgtcgtggcgacgctgcccatccctgtggtgttcgtcctgcggcacttccacctgctctctgatggctccaacaccctctccgtgtcctacaagaagggccgcatgatgaaggacatctccaacctggaggagaacgatgagacccgcttcatcctcagcaaggtgcccagtgaggcaccttcccccatgcccactcaccgttcctatctggggcccggcagcacatcacccctggagaccagcggtaaccccaatggacgctatgggagcggctacctgctggccagcacccctgagtcggagctgtgaccactgcccaagccctgcccgcctctccccccacgctcaacctgcccacttgtccaggcctggcctctttcttgaggtggccaccaggcccaggccaggccctttgcccaagaagagagggtctgccctgcctcactcccctcttcagtcccagtagactctgctccctagccctgagcaggaggctgggagcagctctgtttcctaattcaggaccccactcatctagccctccaagagcctccgccaaattgtagccatgtaattggaacaacccataaggcctgcttcccagtccatgggagattccaagtggccactgcaggagtcactcacctccctctctccctgtaacttgccacctgcagttcttagggctgtggggtcagatggtggtggtgagaggccttggggctggggaaggagagtggactttggctcactctgccatgagaacaggacaccatcctgcccagcccagacggggttgctcctggtccaagaggctacctgctccaaggcggagggtgggagcaggtgtgccagggctcagggctcagacttgggagggcctaggcagaagccccaagttctgttttctgaggtatgtgctgcccttggcttcagcatgagccttggtagcagaaggtgaggaacctcctctgccctggtccctgggtggaatcttcccatgtccttggccctgcctggggtgtgtggtgtgtgctcctgcatcttgtctgggagtgcagtgaccgggaccagaaccttccccacctcaattagggcttagccatctccctgtccccagcacccctccccagcccacagtggtggcctctgcctctttcctggagagagaaggacagtgcacggagaggtttccagagcacaaattgttggttcctagcacaaattagatggtttggagcacaatggtgaagcacactcccctccctcctcacctggggtccaatgttctgtctagtggcagcttttcccctggaacaggggtccctggagttcacaggcttatccccaggaagcctcactcctggggaaagacagataatttcactgcccctttgagccaccactcactctccttattacacaagcacagccgcccagtgtgcacatcatgtgcagacaccttggaaacctttcccaagccttcctggcccacagtggccagtgccataggcagtgctgtggacagtagaggctgccaaaggcaagggctggtcttcaggatggaggccagcctgtgcagaaggctgcagctgacaacagcgaccccacctgccattaccttcagggcctcctctggaagagaacccattctcagagtgcagccagggaggaacctgacccaagagtaaatgtctgcagagagatggatggatggatggatagatggatggatgggttggggagtgggggtggatggatggatagatggatggatggatggatggatgggttggggggtgggggtggatggatagatggatggatggatggacggatggggtgggggaaggaaggaaaggagggagaaaggagggaatactggctccatctttgagagctctggtgggcagggcagaaacaggccacagtgctcaacccggacaccctcacgaagggtcgcaagtcactcttgtggctcagattgctcttaggacctggagggacagaccagaatcagggtcccctcctttacccctgagttccttactgttcccccaagcctgggagcagtctatcccccaaccctgccatctcccttactcatccctcttccacagcttcccctttctagccccctctgccctacctgtctttcctgagtgtttgaggggagagagagacccacatctccccaaagagatgagcttttggggcacaacatcccaccgcagtccccctcacccgacaacacctcctacctggccccttgccaaatcccaagcagaattagcaacaggaaaagcagagccccaggagagacactctactatatatactcttctatatattctgtttctattgtatattcactctgtacatgtgggtgtaaatgctgttaaatgacaaacccaatattatactgtggctggtggactattttcatcctcagtgctgtacagatctattttcattgtatatttgatatatttttaattttgtagcgtgtggctgggccaggccccagcgggaggggctgagctggggctgtgtgcttgctaggtgtgggcgcgctagtgctcgttgtagccttttgctgtgtcttcgctgtgtgttagacgtagggcctagagctcggggtgtgtgtgtgcgtgctgtgtgtatggtgtgcacatacgtgagtgtgggtgtgtgtagcgtgctgatctgtgactcccagtgttcaccaccttcctgaagaccacgctccctccccctgcctcctcctcctcctcttggctctattgggagcctcagggccggcagggtgcttcgggagccccctgctacggggaaaggcatgtgtttcttgctggtgactcattgccttcacaccactgggtttgccagaaacagggaaggagggcgttaagggaaaaaaaaaatcctcaaatttatttaccagtcagcttcttgctgttcccagtagaatcgctagctcttctccagaggaaaagtactaggattcttaagatggcgagaccccaagagggatctcatagcactgctgcatttgccgttgacgcagtcctgacagtgtttgaaaagggccgcctgccccctccccactgtgcttttgatgcctttggagtcaaaggcaggtggggtcacctgatgagctaagatccagccccagaatcctggaggagcaggaggtagcaggagaggaccaggtccccaagtcccttcacagggtccccacccccactggctttggtgctgtccacacagtgcccaccagaaggcagagggaactccagggcagggatgtgcctgaaagagtcaacagtcccctgatcccctacctctgcctgccctccagccccatcaccagcttcttgctcagggagacttccgccctcctcactgaggcaacatgaagcccgaggcccagatgggggctgaacaggtagggcacatcagttaatgccagtgaggtcagcttctgccctccagcaatacatgtgcaggggttgctgctttcccagtgccaggagaacccccgctccgagtcagcctgtgtgggtcatgaggctggggcccaggagacacggtcccaggcactgcacaggcctgcagtattaccaggcggaggggctgcttttctgcccttcctcacccccacgccccaccccactcccccagagtactccccactgtgaaaagagctggaaactaaactggttagaatgaacctggctccctgagcatccctggatccttcaaataggccctgagatgtgaggtctgctgcttcactggggcccgatgactttggctgggggagggggcctagggcctcttctcattgaaagctctgctttatacagacccaagcatacacaccaggccgtcactttgggttctggcataagttcagaacaattcaagtccatgtgtcccatggctggtcagagccctgggtcaaaaccactcagcccaggggaggggatgaggcattgtcaccctagacccctcttcctctctcccccaccatagtgtgcaataaagtgtctgttcttacc

SEQ ID NO: 6463 - DNA, 9645 bp, Homo sapiens
ggtttgtaatgatagggcggcagcagcagcagcagcagcagtggtggaacgaggaggtggagaattgagagcacgatgcatacacaggtgtttctgagtagtaattagatcgctgtgaaggaaaaagcacacctttgagttttcacctgtgaacactatagcgctgagagagacagtctgaaagcagaggaagacatcgatcagtaacaccaagagacaccaaagttgaaagttttgttttctttccctctgttttatttttcccccgtgtgtccctactatggtcagaaagcctgttgtgtccaccatctccaaaggaggttacctgcagggaaatgttaacgggaggctgccttccctgggcaacaaggagccacctgggcaggagaaagtgcagctgaagaggaaagtcactttactgaggggagtctccattatcattggcaccatcattggagcaggaatcttcatctctcctaagggcgtgctccagaacacgggcagcgtgggcatgtctctgaccatctggacggtgtgtggggtcctgtcactatttggagctttgtcttatgctgaattgggaacaactataaagaaatctggaggtcattacacatatattttggaagtctttggtccattaccagcttttgtacgagtctgggtggaactcctcataatacgccctgcagctactgctgtgatatccctggcatttggacgctacattctggaaccattttttattcaatgtgaaatccctgaacttgcgatcaagctcattacagctgtgggcataactgtagtgatggtcctaaatagcatgagtgtcagctggagcgcccggatccagattttcttaaccttttgcaagctcacagcaattctgataattatagtccctggagttatgcagctaattaaaggtcaaacgcagaactttaaagacgccttttcaggaagagattcaagtattacgcggttgccactggctttttattatggaatgtatgcatatgctggctggttttacctcaactttgttactgaagaagtagaaaaccctgaaaaaaccattccccttgcaatatgtatatccatggccattgtcaccattggctatgtgctgacaaatgtggcctactttacgaccattaatgctgaggagctgctgctttcaaatgcagtggcagtgaccttttctgagcggctactgggaaatttctcattagcagttccgatctttgttgccctctcctgctttggctccatgaacggtggtgtgtttgctgtctccaggttattctatgttgcgtctcgagagggtcaccttccagaaatcctctccatgattcatgtccgcaagcacactcctctaccagctgttattgttttgcaccctttgacaatgataatgctcttctctggagacctcgacagtcttttgaatttcctcagttttgccaggtggctttttattgggctggcagttgctgggctgatttatcttcgatacaaatgcccagatatgcatcgtcctttcaaggtgccactgttcatcccagctttgttttccttcacatgcctcttcatggttgccctttccctctattcggacccatttagtacagggattggcttcgtcatcactctgactggagtccctgcgtattatctctttattatatgggacaagaaacccaggtggtttagaataatgtcggagaaaataaccagaacattacaaataatactggaagttgtaccagaagaagataagttatgaactaatggacttgagatcttggcaatctgcccaaggggagacacaaaatagggatttttacttcattttctgaaagtctagagaattacaactttggtgataaacaaaaggagtcagttatttttattcatatattttagcatattcgaactaatttctaagaaatttagttataactctatgtagttatagaaagtgaatatgcagttattctatgagtcgcacaattcttgagtctctgatacctacctattggggttaggagaaaagactagacaattactatgtggtcattctctacaacatatgttagcacggcaaagaaccttcaaattgaagactgagatttttctgtatatatgggttttgtaaagatggttttacacactatagatgtctatactgtgaaaagtgttttcaattctgaaaaaaagcatacatcatgattatggcaaagaggagagaaagaaatttattttacattgacattgcattgcttccccttagataccaatttagataacaaacactcatgctttaatggattatacccagagcactttgaacaaaggtcagtggggattgttgaatacattaaagaagagtttctaggggctactgtttatgagacacatccaggagttatgtttaagtaaaaatccttgagaatttattatgtcagatgttttttcattcattatcaggaagttttagttatctgtcatttttttttttcacatcagtttgatcaggaaagtgtataacacatcttagagcaagagttagtttggtattaaatcctcattagaacaaccacctgtttcactaataacttacccctgatgagtctatctaaacatatgcattttaagccttcaaattacattatcaacatgagagaaatcaccaacaaagaagatgttcaaaataatagtcccatatctgtaatcatatctacatgcaatgttagtaattctgaagttttttaaatttatggctatttttacacgatgatgaattttgacagtttgtgcattttctttatacattttatattcttctgttaaaatatctcttcagatgaaactgtccagattaattaggaaaaggcatatattaacataaaaattgcaaaagaaatgtcgctgtaaataagatttacaactgatgtttctagaaaatttccacttctatatctaggctttgtcagtaatttccacaccttaattatcattcaacttgcaaaagagacaactgataagaagaaaattgaaatgagaatctgtggataagtgtttgtgttcagaagatgttgttttgccagtattagaaaatactgtgagccgggcatggtggcttacatctgtaatcccagcactttgggaggctgagggggtggatcacctgaggtcgggagttctagaccagcctgaccaacatggagaaaccccatctctactaaaaatacaaaattagctgggcatggtggcacatgctggtaatctcagctattgaggaggctgaggcaggagaattgcttgaacccgggaggcggaggttgcagtgagccaagattgcaccactgtactccagcctgggtgacaaagtcagactccatctccaaaaaaaaaagattatatatatatatatatgtgtgtgtatgtgtgtgtgtgtgtgtgtgtgtatatatatatatatatatatacacacacacacacacactttttatatatatatatatatatatatagtggaacttacaaatgagagtaatataatgatgaaattttgaactgttatttataaacatctaaggtaaaatggttagtcatggccagagtatgtttcatcctttaatttttgtccatttgaaaataaggatttttgaaagaattataccaattaaaattattaaaggcaaacatagaattcataaaaaattgtccaaagtagaaatgatgacctataatttggagcatttccaattcagtaatttcaattttgctcttgaaaacatttaatatatatccaagactgacatttctttagctgaacctaacgtttgggtctctgagtgaatttataataactccttccttccttagcatagggttttcaaaatttgatttataattcctatttccagtaaatattgttcatttgtccacatctctccctatgatatgttgctggaggtaagaatttctttcatattcctattttttttttccccatagactaggctcatagaatttaaacaagcaaattttcctgagctttttcttgccaaatgaaagaagactggtaaattctcatagagaggtttgtgtagttcttggctcttcctggggttaatgtgcttatattcacagtggcaaattggtctcagactttaatttatttatttttgatttgaatttctctttaaaagtatcaatttaaaaggtaactagaattattctttctcattttcaaaagtgatttttgcattattaaatttccctgccattgtaatgccatttcacgcagaaaaaaagtcagccagtaattaagaaaaaaagtgatggagattaagtagtattttggcttatttttaggactcatcatgagaagacacagttcctttaatcaggaaattaatatccataattttcactcaaaattgcagtatgtaaagcagattctcaaaaactctcctgaacacttatttatatatatgtttttatataagtaaaatttttctcatatttttatacgatatgcacacacacacatacatgcacatactacttactacatgttctgtacttgtactttgtaccatgcatattcaaatgtttatatacataagtttattataacataaacagtaaaagtaatgaatactgtttaaaataactaatatagtattttttaatttttgtggggatggattctcaaatacttgtgattttaaaagattctaaagctaaaacacaacttgattttaaaaagaatgattctccttacacaattataaatatttgcagtaaatattttccttataatactgttttgaccccatttaaaaagtattagattatattcctttgatccaatgaaaactgaaccttataaatggttagctgaaagtagaccttattcttgtccttctttagaagagtaaagatttgtcctagggaagatggctgacttcggttcccaacatgcgtatgcatttagactgtagctcctcagccctgtggacacaaaatttggacagcttattaggttacgttagcaatgcatgacggtttctccaacactaagatattcacgttgaaacagatttcctgttcgtcttatgtgtctggtaaaattgtttccccaattacaatttgacatatcaatagagggttaacaagagtataattacataacagaattcctcatgaactgtaatcagtctacaggaaaatcattattttatcttgatttgcagatgaatatactgctaagaaagggagcaactctgacctttgttaaagttgatcttttgtaattgaggtataaggtatgaaaagataaaaaaccgaaggccagagaatcaggaaatgaaagatagtatggactgaaggtaacaatattttaatgttatgcaatatagtcagagaaatattaaaaattagttgtttgctgtgcataggtggatctcgcaggaagctaatgaaacctaagcttcagtgcctctcacttagacatgttccattcgaggtcctgaacctaactttgtattaggaattctgtactaattttgttgaagaagaccagcaaagttgtgtacacttctacccccacaaaatctgcattgtccatgtgagtaaagtaaaataattcctgttatttttttctgttagaaataagtatggaggatatgtttttaaaaatttatgagttaattgaaatatccatatataacaagtgactttctcacaatatatatgatgtgatatatagggagatagtttcactttcatcatattttatacgttgattctgaactatagaaaaataataaatgggattttaattatagctcttagttgggaaagaaatatagagagatgtgggatttgaatgcccatgaaagacattttattttacttgaatatattcttgcttcactttaccctccataatatgttgtacattagtgctgatcaagtttacagagttacattttgctttcctaaccattcagtcaggaattaaaatatggcattgtataacaactgggaagaagctcatagtggatataaattagagtagataatgggtcaccttgatagcctctgtttacattacttgtatatgggcaaaataattattacctatacgtgtatttaagcttaattttcatataaacagtatttttaatctatgttaaaatagataatatctaaaagtgtgatctctaggtagtccttagtttattagtactgtacttcaaaaagatttttaaataggtccggcacggtggctcatgcctgtaatcccagcactttgggaggctgaggcgggcgaatcacctgaggtcaggagttcgagatcagcctggccaacatggtgaaaccctgtctcaactaaaaatataaaaattagccgggcgtggtggcaggcgcctgtaatcccagctactcgggaggctgaggcaggagaatcacttgaacccaaggggcagaagctgcagttagccaagatcgcatcattgcactccagcctaggggacaagagcgcgagacttcatctcaaaaaaaaaaaaaaaaaaaaaaaaagatttttaaataatagctaaaggtatgctctctaggtcatccttagtttattagtactgtacttaaaaattattttttaatagtcaattttgggagataattatttctttccttatattttccaattagttggtgtctaaaaataaatgttttgtctaattttagatcaggtatacattcacaaaagcataaatcatagtctcacaggaaattcaccaattttccatatgtcgtgagataactgtcctttctacaacctcataacaatgaatttatataattacctagattttcttagtgtgaatctacccattagttttattttcttggtagttatttttttccctcctctctgttactattggccttaaaatacacagaggacggttacagtgtcctaatagctgttacatgtgtgtgtttcagcgtacttgaatcaagtgtacatttatagtaccaataaccgcctttacagctttacagttaacaattctctcacaaaactgtagagcattaggcatctgagagccatagagggccaactttgttccagagtgaacatgctttttttcctcaacatatacactactgattttttttaaaagtatgactttcaagtgaattaatgtattggttaggagaactgcttgctaagtccttattacctcttgttaaagcctcagaaggccgtgctgaaagccagaggggaaaaaaagagtaatgcacaggtatctcttttgcagtggtgactgtattttgagtaccttgtgtgacagggtattattacagcatcttgtgggaaaacctattaggcctttgcatgttaaagctgtataatttgttgggttgtgagtggtctgacttaaatgtgtattataaaatttagacatcaaattttcctactaactaactttattagatgcatacttggaagcacagtcatatcacactgggaggcaatgcaatgtggttacctggtcctaggtttgaactgtcttatttcaaaagatttctgaattaatttttccctagaatttctccttcattccaaagtacaaacatactttgaagaatgaaacagattgttcccatgaatgtatgctcatactcgactagaaacgatctatgttaaatgactgtgtatatgaattatttcaagtactaccccaaataactttcttattgctctgaaagaagaaaagcaatgtaaatcactatgattattgcacaaacaaccagaattctccaacaattttaagtaatctgatcctcttcttggagaaaattgttacctaatagtttttccttatgaatgttattactactggtataaatcaaatttctataaatttcctacttaagtcttaagaactgggttcttcctttgatgttattcatgttcagaaaggaaacaacactttactcttttaggacaattcctagaatctatagtagtatcaggatatattttgctttaaaatatattttggttattttgaatacagacattggctccaaattttcatctttgcacaatagtatgacttttcactagaacttctcaacatttgggaactttgcaaatatgagcatcatatgtgttaaggctgtatcatttaatgctatgagatacattgttttctccctatgccaaacaggtgaacaaacgtagttgttttttactgatactaaatgttggctacctgtgattttatagtatgcacatgtcagaaaaaggcaagacaaatggcctcttgtactgaatacttcggcaaacttattgggtcttcattttctgacagacaggatttgactcaatatttgtagagcttgcgtagaatggattacatggtagtgatgcactggtagaaatggtttttagttattgactcagaattcatctcaggatgaatcttttatgtctttttattgtaagcatatctgaatttactttataaagatggttttagaaagctttgtctaaaaatttggcctaggaatggtaacttcattttcagttgccaaggggtagaaaaataatatgtgtgttgttatgtttatgttaacatattattaggtactatctatgaatgtatttaaatatttttcatattctgtgacaagcatttataatttgcaacaagtggagtccatttagcccagtgggaaagtcttggaactcaggttacccttgaaggatatgctggcagccatctctttgatctgtgcttaaactgtaatttatagaccagctaaatccctaacttggatctggaatgcattagttatgaccttgtaccattcccagaatttcaggggcatcgtgggtttggtctagtgattgaaaacacaagaacagagagatccagctgaaaaagagtgatcctcaatatcctaactaactggtcctcaactcaagcagagtttcttcactctggcactgtgatcatgaaacttagtagaggggattgtgtgtattttatacaaatttaatacaatgtcttacattgataaaattcttaaagagcaaaactgcattttatttctgcatccacattccaatcatattagaactaagatatttatctatgaagatataaatggtgcagagagactttcatctgtggattgcgttgtttcttagggttcctagcactgatgcctgcacaagcatgtgatatgtgaaataaaatggattcttctatagctaaatgagttccctctggggagagttctggtactgcaatcacaatgccagatggtgtttatgggctatttgtgtaagtaagtggtaagatgctatgaagtaagtgtgtttgttttcatcttatggaaactcttgatgcatgtgcttttgtatggaataaattttggtgcaatatgatgtcattcaactttgcattgaattgaattttggttgtatttatatgtattatacctgtcacgcttctagttgcttcaaccattttataaccatttttgtacatattttacttgaaaatattttaaatggaaatttaaataaacatttgatagtttacataa

SEQ ID NO: 6464 - DNA, 1878 bp, Homo sapiens
agaattattttatttcaggaatccatcaacatcctttgcagctacataggcaggaaaatctagaaattgtaatttatatagaattttaaaactcttcaattacaatggatagaggggagaaaatacagctcaagagagtgtttggatattggtggggcacaagttttttgcttattaatatcattggtgcaggaatttttgtgtcccccaaaggtgtgttggcatactcttgcatgaacgtgggagtctccctgtgcgtttgggctggctgtgccatactggccatgacatcaactctttgctctgcagagataagtataagcttcccatgcagtggagctcaatactattttctcaagagatactttggctccacggttgcttttttgaatctctggacatccttgtttctggggtcaggggtagttgctggccaagctctgctccttgctgagtacagcatccagcctttttttcccagctgctctgtcccaaagctgcctaagaaatgtctggcattggccatgttgtggattgtaggaattctgacttctcgtggtgtgaaagaagtgacttggcttcagatagctagctcagtgctgaaagtgtccatacttagcttcatttccctaactggagtagtgttcctgataagagggaaaaaggagaatgtagaacgatttcagaatgcttttgatgctgaacttccagatatctctcaccttatacaagccatcttccaaggatattttgcatattcaggcggggcatgctttacacttatagcaggggagctgaagaagcccagaacaacaattcccaaatgcatatttactgcgttacctctggtgactgtagtttatttactggttaacatttcctatctgactgttctgacacccagggaaattctctcttcagatgctgtagctatcacatgggctgatcgagcttttccctcattagcatggattatgccttttgctatttctacctcattatttagcaaccttctgatttctatatttaaatcatcgagaccaatatatcttgcaagccaagagggccagctgcctttgctatttaatacacttaatagtcactcttctccatttacagctgtgctactacttgtcactttgggatcccttgcaattatcttaacaagtctaattgatttgataaactatatttttttcacgggttcattatggtctatattattaatgataggaatactaaggcggagataccaggaacccaatctatctataccttataaggtgtttttgtcatttccattagcaacaatagtcatcgacgtgggcttggttgtgataccattggtaaagtctccaaatgtgcattatgtctacgtgcttctgttagttctcagcggattactattttacatacctttaatacattttaaaataagattggcttggtttgagaagatgacttgctatttacaattactatttaatatttgcctccctgatgtgtctgaggaatagatgtcggaagtgcaaactcttaaaaaattggccttctaaaaaacatatatcagattccaaatcaaggttaaacatatgatagaacattcatggtgaaattcctatggtaaatatttttttctcaaatgaaataagtaatgtatacaaaagtgcctaagacagtacctggcttcagagtcactaagaaattgctaaaagctctgcttcgcatggtaaaaaacttaagtcctggtttgcgtagcttgatagagtgattatacaacttccattctctcactttttttttctgtatcccaccccttttctactgaatttgtggggatcctataataaaagtgaatgactaaaaattttaaaagca

SEQ ID NO: 6465 - DNA, 1618 bp, Homo sapiens
tccatcaacatcctttgcagctacataggcaggaaaatctagaaattgtaatttatatagaattttaaaactcttcaattacaatggatagaggggagaaaatacagctcaagagagtgtttggatattggtggggcacaagttttttgcttattaatatcattggtgcaggaatttttgtgtcccccaaaggtgtgttggcatactcttgcatgaacgtgggagtctccctgtgcgtttgggctggctgtgccatactggccatgacatcaactctttgctctgcagagataagtataagcttcccatgcagtggagctcaatactattttctcaagagatactttggctccacggttgcttttttgaatctctggacatccttgtttctggggtcaggggtagttgctggccaagctctgctccttgctgagtacagcatccagcctttttttcccagctgctctgtcccaaagctgcctaagaaatgtctggcattggccatgttgtggattgtaggaattctgacttctcgtggtgtgaaagaagtgacttggcttcagatagctagctcagtgctgaaagtgtccatacttagcttcatttccctaactggagtagtgttcctgataagagggaaaaaggagaatgtagaacgatttcagaatgcttttgatgctgaacttccagatatctctcaccttatacaagccatcttccaaggatattttgcatattcaggggagctgaagaagcccagaacaacaattcccaaatgcatatttactgcgttacctctggtgactgtagtttatttactggttaacatttcctatctgactgttctgacacccagggaaattctctcttcagatgctgtagctatcacatgggctgatcgagcttttccctcattagcatggattatgccttttgctatttctacctcattatttagcaaccttctgatttctatatttaaatcatcgagaccaatatatcttgcaagccaagagggccagctgcctttgctatttaatacacttaatagtcactcttctccatttacagctgtgctactacttgtcactttgggatcccttgcaattatcttaacaagtctaattgatttgataaactatatttttttcacgggttcattatggtctatattattaatgataggaatactaaggcggagataccaggaacccaatctatctataccttataagagtctcattcttgtcgtccaggctggagaagctggagtgcagtggcatgatcttggcttgctgcaacctctgcttcctgggttcaagagattctcctgcctcagcctcccaagtagctgggattacaggtgtttttgtcatttccattagcaacaatagtcatcgacgtgggcttggttgtgataccattggtaaagtctccaaatgtgcattatgtctacgtgcttctgttagttctcagcggattactattttacatacctttaatacattttaaaataagattggcttggtttgagaagatgacttgctatttacaattactatttaatatttgcctccctgatgtgtctgaggaatagatgtcggaagtgcaaactctt

SEQ ID NO: 6466 - DNA, 2235 bp, Homo sapiens
ataaggggcgcttggcgcgcaacgaccccaagccgcagctttgaagcctgagcggccgaactcggcagctccaacccaactcggcttaactccgcctcaccgagcccagtccaagactctgtgctccctaggtttgcaacagctctctggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtag

SEQ ID NO: 6467 - DNA, 2236 bp, Homo sapiens
aagccgcagctttgaagcctgagcggccgaactcggcagctccaacccaactcggcttaactccgcctcaccgagcccagtccaagactctgtgctccctaggtttgcaacagctctctgatcatcttcttcaattcctgctaggatgccgtggcaagcatttcgcagatttggtcaaaagctggtacgcagacgtacactggagtcaggcatggctgagactcgccttgccagatgcctaagcaccctggatttagtggccctgggtgtgggcagcacattgggtgcaggcgtgtatgtcctagctggcgaggtggccaaagataaagcagggccatccattgtgatctgctttttggtggctgccctgtcttctgtgttggctgggctgtgctatgcggagtttggtgcccgggttccccgttctggttcggcatatctctacagctatgtcactgtgggtgaactctgggccttcaccactggctggaacctcatcctctcctatgtcattggtacagccagtgtggcccgggcctggagctctgcttttgacaacctgattgggaaccacatctctaagactctgcaggggtccattgcactgcacgtgccccatgtccttgcagaatatccagatttctttgctttgggcctcgtgttgctgctcactggattgttggctctcggggctagtgagtcggccctggttaccaaagtgttcacaggcgtgaaccttttggttcttgggttcgtcatgatctctggcttcgttaagggggacgtgcacaactggaagctcacagaagaggactacgaattggccatggctgaactcaatgacacctatagcttgggtcctctgggctctggaggatttgtgcctttcggcttcgagggaattctccgtggagcagcgacctgtttctatgcatttgttggtttcgactgtattgctaccactggagaagaagcccagaatccccagcgttccatcccgatgggcattgtgatctcactgtctgtctgctttttggcgtattttgctgtctcttctgcactcaccctgatgatgccttactaccagcttcagcctgagagccctttgcctgaggcatttctctacattggatgggctcctgcccgctatgttgtggctgttggctccctctgtgctctttctaccagcctcctgggctccatgttccccatgcctcgggtgatctacgcgatggcagaggatggcctcctgttccgtgtacttgctcggatccacaccggcacacgcaccccaatcatagccaccgtggtctctggcattattgcagcattcatggcattcctcttcaaactcactgatcttgtggacctcatgtcaattgggaccctgcttgcttactccctggtgtcgatttgtgttctcatcctcaggtatcaacctgatcaggagacaaagactggggaagaagtggagttgcaggaggaggcaataactactgaatcagagaagttgaccctatggggactatttttcccactcaactccatccccactccactctctggccaaattgtctatgtttgttcctcattgcttgctgtcctgctgactgctctttgcctggtgctggcccagtggtcagttccattgctttctggagacctgctgtggactgcagtggttgtgctgctcctgctgctcattattgggatcattgtggtcatctggagacagccacagagttccactccccttcactttaaggtgcctgctttgcctctcctcccactaatgagcatctttgtgaatatttaccttatgatgcagatgacagctggtacctgggcccgatttggggtctggatgctgattggctttgctatctacttcggctatgggatccagcacagcctggaagagattaagagtaaccaaccctcacgcaagtctagagccaaaactgtagaccttgatcccggcactctctatgtccactcagtttgacatcgtcacacctaaatgctgtctggtcccctgcacaataatggagagtactcctgaccccagtgacagctagccctcccctgtgatggtggtggtggatactaatacagttctgtacgatgtgaaggatgtgtctttgctatttcttgtctattttaacccgtctgcttctaaatgatgtctagctgcttaccaactttaaaaaatgatattaaaagaaagtagaaaaat

SEQ ID NO: 6468 - DNA, 1946 bp, Homo sapiens
agtcccgggcccggagccagcgcatgcgcccgcctgtgggcgctgtcccggctgcgagggccgtgagctcacggaccgacggaccgacgggcggccggccggacagacggggcagcgcagggagcggggacgcggcgggacagcgacatggccggccacacgcagcagccgagcgggcgcgggaaccccaggcctgcgccctcgccctccccagtcccagggaccgtccccggcgcctcggagcgggtggcgctcaagaaggagatcgggctgctgagcgcctgcaccatcatcatcgggaacatcatcggctcgggcatcttcatctcgcccaagggggtcctggagcactcaggctccgtgggtctggccctgttcgtctgggtcctgggtgggggcgtgacggctctgggctccctctgctatgcagagctgggagtcgccatccccaagtctggcggggactacgcctacgtcacagagatcttcgggggcctggctggctttctgctgctctggagcgccgtcctcatcatgtaccccaccagccttgctgtcatctccatgaccttctccaactacgtgctgcagcccgtgttccccaactgcatcccccccaccacagcctcccgggtgctgtccatggcctgcctgatgctcctgacatgggtgaacagctccagtgtgcgctgggccacgcgcatccaggacatgttcacaggcgggaagctgctggccttgtccctcatcatcggcgtgggccttctccagatcttccaaggacacttcgaggagctgaggcccagcaatgcctttgctttctggatgacgccctccgtgggacacctggccctggccttcctccagggctccttcgccttcagtggctggaacttcctcaactatgtcaccgaggagatggttgacgcccgaaagaacctacctcgcgccatcttcatctccatcccactggtgaccttcgtgtacacgttcaccaacattgcctacttcacggccatgtccccccaggagctgctctcctccaatgcggtggctgtgaccttcggggagaagctgctgggctacttttcttgggtcatgcctgtctccgtggctctgtcaaccttcggagggatcaatggttacctgttcacctactccaggctgtgcttctctggagcccgcgaggggcacctgcccagcctgctggccatgatccacgtcagacactgcacccccatccccgccctcctcgtctgttgcggggccacagccgtcatcatgctcgtgggcgacacgtacacgctcatcaactatgtgtccttcatcaactacctctgctacggcgtcaccatcctgggcctgctgctgctgcgctggaggcggcctgcactccacaggcccatcaaggtgaaccttctcatccccgtggcgtacttggtcttctgggccttcctgctggtcttcagcttcatctcagagcctatggtctgtggggtcggcgtcatcatcatccttacgggggtgcccattttctttctgggagtgttctggagaagcaaaccaaagtgtgtgcacagactcacagagtccatgacacactggggccaggagctgtgtttcgtggtctacccccaggacgcccccgaagaggaggagaatggcccctgcccaccctccctgctgcctgccacagacaagccctcgaagccacaatgagatttttgtagagactgaagcagttgtttctgtttacatgttgtttattgaggaggtgttttggcaaaaaagttttgttttgtttttttctggaaaaaaaagaaaaaagatacgactctcagaagcctgtttaaggaagccctaaaatgtggactgggtttcctgtcttagcactgccctgctagctcttcctgaaaaggcctataaataaacagggctggctgttc

SEQ ID NO: 6469 - DNA, 5122 bp, Homo sapiens
atctgaataattgaggagctgttcagcagcagcggctgcctcctgccttcctttgccgccaccaccacttcccatcccagctagagagacagctccgcgcagtaagtgcggactgccagccaccagccttggcagccagctcgtcgcctccagccccgaccccgacattcatgcccaggagaaggctgcactgggtccctctgggcctttcctaaaagggagatccctgttcactagatgagttccagaaccatccactaaggctttgtagcccccttccatcagctgaccttcactgcatcccctatcgctcaagatgagtggcttcttcacctcgctggacccccggcgggtgcagtggggagctgcctggtatgcaatgcactccaggatcctacgcaccaaaccagtggagtccatgctagagggaactgggaccaccacggcacatggaactaagctagcccaggtactcaccacagtggacctcatctctcttggcgttggcagctgtgtgggcactggcatgtatgtggtctctggcctggtggccaaggaaatggcaggacctggtgtcattgtgtccttcatcattgcagccgtcgcatccatattatcaggcgtctgctatgcagagtttggagttcgagtccccaagaccacaggatctgcctacacctacagctatgtcactgttggggaatttgtggcatttttcattggctggaacctgatcctggagtacctgattggcactgcggccggagccagtgctctgagcagcatgtttgactcactagccaaccacaccatcagccgctggatggcggacagcgtgggaaccctcaatggcctggggaaaggtgaagaatcatacccagaccttctggctctgttgatcgcggtcatcgtgaccatcattgttgctctgggggtgaagaattccataggcttcaacaatgttctcaatgtgctgaacctggcagtatgggtgttcatcatgatcgcaggcctcttcttcatcaatgggaaatactgggcggagggccagttcttgccccacggctggtcaggggtgctgcaaggagcagcaacatgcttctacgctttcattggctttgacatcatcgccaccactggagaggaagccaagaatcccaacacgtccatcccttatgctatcactgcctccctggtcatctgcctgacagcatatgtgtctgtgagcgtgatcttaactctgatggtgccatattataccattgacacggaatccccactcatggagatgtttgtggctcatgggttctatgctgccaaattcgtagtggccattgggtcggttgcaggactgacagtcagcttgctggggtccctcttcccgatgccgagggtcatttatgccatggctggtgacgggctccttttcaggttcctggctcacgtcagctcctacacagagacaccagtggtggcctgcatcgtgtcggggttcctggcagcgctcctcgcactgttggtcagcttgagagacctgatagagatgatgtctatcggcacgctcctggcctacaccttggtctctgtctgtgtcttgctccttcgataccaacctgagagtgacattgatggttttgtcaagttcttgtctgaggagcacaccaagaagaaggagggcattctggctgactgtgagaaggaagcttgttctcctgtgagtgagggggatgagttttctggcccagccaccaacacatgtggggccaagaacttaccatccttgggagacaatgagatgctcatagggaaatcagacaagtcaacctacaacgtcaaccaccccaattacggcaccgtggacatgaccacaggcatagaagctgatgaatccgaaaatatttatctcatcaagttaaagaagctgattgggcctcattattacaccatgagaatccggctgggccttccaggcaaaatggaccggcccacagcagcgacggggcacacggtgaccatctgcgtgctcctgctcttcatcctcatgttcatcttctgctccttcatcatctttggttctgactacatctcagagcagagctggtgggccatccttctggttgttctgatggtgctgctgatcagcaccctggtgtttgtgatcctgcagcagccagagaaccccaagaagctgccctacatggccccttgcctcccctttgtgcctgcctttgccatgctggtgaacatctatctcatgctaaagctctccaccatcacatggatccggtttgcggtctggtgctttgtgggtctgctcatttattttggatatggcatctggaacagcaccctggaaatcagcgctcgagaagaggccctgcaccaaagcacgtaccaacgctacgacgtggatgaccccttctcagtggaggagggtttctcctacgccacagagggcgagagccaggaggactggggcgggcccactgaagacaaaggcttctattaccaacagatgtcagatgcgaaggcaaacggccggacaagtagcaaagcgaagagcaaaagcaaacacaaacagaactcagaggccctgattgcaaatgatgagttagattactctccagagtaggagaaacacacaagtgggtagaaatggtgatgactgattttcagtaacttaacctgtgggctagaaggtgaaaacttttttggctctcatttcacaaatccagccttccccaaattcaatccctagtcatagcctgtcatttgctacttttgctcttcaggatagttctgttgaagggcttaacctgggtcccctaactggtcgccttgttaaataaaataaataaataaacaagaggctatatgaaattccatcttaggtgcaaccaccagagctgatggtaccaaatgtttcctaggcctttgctttgctggttgaagcccaagcaggggctctgggcagaaggcagaatttcagtcacctgagacatggggacaaagctctgttcttggcatgtcaggctgagtgctgctccccgaggtcagggtgggtagatgggcattggcacttcctgagcaagcatcattttatcctgcaatctcacccaaaattaattcatggaaaagacacatgcttctttttattcaccaacattctcacagcttccaaactataattttaggatccagcaaagttcagggactctggaccattttcccaatggtttcagattcaccataaagcagtcaggcagacccagtgatatggtaagaagcaccatcaaagctctatgtaaatgcccagaagaaaattaaataaccatatcttgcggtaaaagccagaagggcattggcagaaattaactctctgtcatggcctctcttatatcagactgcagctcctggtgatatgatgaaagcgggcaaaggtggagcatgatttcatggcactgatatgccttgaaaaagtaggttgtttgttttataatcagataaaaatttttacaaggagaagtgagccagccactgagatcacattgcaaattctctttcatatttctaaaattataaattctaaagtttttgagataggcaaccacttgattggtgtgtgctactctgaaaacaaaataggctgaagtatagcgacttaggtagttgcattccatgagatcacatttcacttctgaaccttattccttggggctagctcactttcagaggtgtatttttttttcctgttatttcccagagtagtttcactgaagcccagagaaatatctacctggtaagatgtaaatttgggccataaaaggggctattaaaagaattttctcagaaatagaatagatgagagaatttgcaaaggaaaaaaacacacatgggctacaatataaattctactcttgggttacaagaattcctgtggctgcactgagatacgtacaaatgtatgtgaaggcacaatttgaatcaagctatcatagaattaaccaagctattaaaattaatcaagctattaataaaatctctgtgaggatttcctgaaagagggacaaaagaagaaattccttgtcctttctctcctggatgtatcagtatgccaaacgttttccagaacatattcgctagcactcaagtctgttctttctgaaaggctgaggctcatgccatcttggcatgctttaggattatggcaaggaggtaaaagtccattttttcattcaactaacactggttgagaatagacccaatgctaagtgacaggaatgaatagaagcatggcacttgcccttgggggctacagtccatggatgagcagcactggagcctggtaaatgcagataaaacaacaaacttgacaagtctccaggctgatgcactgggttttaacatacatataaagatgaattgaaactagtttttaaaaaatatgctttaaataaattacatatcgtaatcatagccaatgtataccattaaactaaaataactgcaattttctagatattttttattcttctgtagtcattgtttagaactctggtttcctgaggtcattttgtcattttaatatcatgcttgacaatgctatgttttctcttccctagagttaaccataaagatacagtgcctactctgtgaaatacagcattaggaattaattataaactaattatcagtcatcttttgaaaacaaagttttgaattggctataggactcaacaaatctgcctggtgtaaatagaatctgttaagcttgatacatatctagatagatgaggaggggttgtattcattaagcatgagaatagagaaataggagtgcaaaatggcaaaatcttaacgtgggtgaaagagcttccttttactagtgaggtttaagtattaaagtaacaatagcctggtggcagatgaatgcaatttctataggatgggaatggaaaatgtatgctttggttaacaccattgctgttgacttcatgcagattctattaagcactctcatttcaggagccatttttcccacatagtatattagtatattttaagcttagctccctttatttttctaaagttgataaatcacctccctagcaaccttagtttt

SEQ ID NO: 6470 - DNA, 2916 bp, Homo sapiens
gagtatcaactcttccagcatggagccgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagaggaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttc

SEQ ID NO: 6471 - DNA, 5250 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 6472 - DNA, 5262 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 6473 - DNA, 5268 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 6474 - DNA, 2622 bp, Homo sapiens
cgaaaacctagggaatgacagctagaggcatccagacgataactggcagccaggagggtggataagtcaaaggaaggggtcaaggaaagaggggaaggaaagggaaccatcacttgctgagcctgctgcctgtgctttctcatgtcacccgcacgacaacccaatgtgaatgttatcatctccaggtaactgctgaagaaacggaagctcaaagagatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggc

SEQ ID NO: 6475 - DNA, 5146 bp, Homo sapiens
cggcgctgtctcccagctgatagggtgacgttccgtttggaggcttggagattggctttttgatttggcttcttccggcagcttaatgggcaaagctctccgctcgcccagaaaccagcctctccgcgcgtcccctctgcgcgcggcgaggccgagacgtctcccgcggtgacagcgtgcaaggcggagacccggcgcgctcccagcccagggaaagcccaggcgacgcgaccgcaagcccgagcccaggtccctcggagccgccagggcgcgccgggctgcttgccttcctgccccttcctgcaggaatcccccgccgcccgcggccgggactccgggcctctcccgggcgtagattccagtcaccgctctgggtcggggtttccctctttctgaaatccgtgcggaaggacccctcccggggcccctcgccctggccccagacaccctccctcccagaccccgcgctccagatgcgctgccccgcagctccctgacagctgcgagcccacgaaccccggcgggagggcggcggcggcggactgacatgccccggacgcggctgcggccggcgggcagcccgcgggggcgatgagccgctgcgaccggtgaggcgccgggcggcgggggcatcgcgtaccttcctcacccccctcccttgcccactccgctcgggaggccgagaggaaacggtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtatgtgacagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaagccacacaacagagcctccagcagggcaggcctaggacttctcctaagagaagggcacttccccaccagtgatctctcccgactgcactgccctggagaggcagcatcaggacctaagccccaggaacttcacccaacttaggccctggcaattaactgaaagggcaaagtcttaatcaatcaaacaatggaggaatcaccgactttacacagtatttaattgaatacaaacaagcaacagcaacaaatccacctccaccccatctccccctcatatccctgacccaaagcaaaggtcagagcctttcgcctccttctattccatcttttgattattcctttgcctctcatttctttggaagcagggtttctcctctctgcccaattccatatgtccctattatctcactcagctgacaagacgtgaaaatgagtcacattcatgtggctggggtggggttcttttttcattgtaatcattattgtggttgctttcgttttgccattaggttttgcttattattttgttttgtcttttttttctgaagtgagtgaaaaaggtgccacaaaggaattccaggtccgagccaacagagagaaacatgaatttttagacacatgctctcctgccacctcttggctccatcaagatccagttccccatctcactgttttctctgagttcttgggaggagtgatggtgttggggtagaaataagctcactcacccacgcagggtactaaagatcttacaggagcttcaactggagcaggaggagctttttatgcttatgttgaatcaagtcagatacaaaaagcaattgtccctctttgcccaagcctttccaattctgtgtgtcttgttgtgtcagtgtccacttgtgtatccttctgcaggaagacccgccaaatagaagagatgggacaaaaataggaatggtgtgtgacgacaaagggctactggaagaacaaaagggatacaggccttcttgattatctttggctttgtacctgaggcaggagagaagagatgtccaaccagtgagatctttaagagaaaagtttgtattttaaatgtcaatgtgcctgagaaatgtcagcttcaccacgctcttgcttcctaatgctctatacaaagagggctgactatatttcttgaagtggtgtaaaaacttagagattttataagagaaccaggggctcccttcacctctcctggtccctcaggtcacatatgaaagcatttttacaagataggaactggaattcctcatttctcccatgttcctgcttgttcttaaacttcatgaagctatttttccagcctatggggtagttcttgctccagtaagaggaatcttagttgtcataatcccttggagcctgggtttttggagaaagagatctccgtgccctacagaccttttctcaacgaatgtgggaaggacctggctttaaaacacgcacacaaacacacaaataaacagacataagatgtcatcacgaaactgcccacggatctttaggctttctgcattgacataaatacattttctaagggggggggggaagaaattaaaaaacacctgttaattttaaacacattttttaagaaaaaaataattaaaaaagaaacagtgctcatgtcataagctatgttgacagttgccagtggaaatgttgggttggttcaaaaaaaaaataaaagctatactatatctctctacata

SEQ ID NO: 6476 - DNA, 2840 bp, Homo sapiens
gtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtcaaaacaattcacatcaaggtaattgatgatgaggcatatgagaaaaacaagaattacttcattgagatgatgggcccccgcatggtggatatgagttttcagaaagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaa

SEQ ID NO: 6477 - DNA, 2837 bp, Homo sapiens
gtctctggcctatcaggaggacaactggtgctgcaatagaagccagtggctaagtctcgtgtatggcgtggttaaggttgcagcctctcacctctgccttcctccattttgggctggttacctttgtgctcttcctgaatggtcttcgagcagaggctggtggctcaggggacgtgccaagcacagggcagaacaatgagtcctgttcagggtcatcggactgcaaggagggtgtcatcctgccaatctggtacccggagaacccttcccttggggacaagattgccagggtcattgtctattttgtggccctgatatacatgttccttggggtgtccatcattgctgaccgcttcatggcatctattgaagtcatcacctctcaagagagggaggtgacaattaagaaacccaatggagaaaccagcacaaccactattcgggtctggaatgaaactgtctccaacctgacccttatggccctgggttcctctgctcctgagatactcctctctttaattgaggtgtgtggtcatgggttcattgctggtgatctgggaccttctaccattgtagggagtgcagccttcaacatgttcatcatcattggcatctgtgtctacgtgatcccagacggagagactcgcaagatcaagcatctacgagtcttcttcatcaccgctgcttggagtatctttgcctacatctggctctatatgattctggcagtcttctcccctggtgtggtccaggtttgggaaggcctcctcactctcttcttctttccagtgtgtgtccttctggcctgggtggcagataaacgactgctcttctacaaatacatgcacaaaaagtaccgcacagacaaacaccgaggaattatcatagagacagagggtgaccaccctaagggcattgagatggatgggaaaatgatgaattcccattttctagatgggaacctggtgcccctggaagggaaggaagtggatgagtcccgcagagagatgatccggattctcaaggatctgaagcaaaaacacccagagaaggacttagatcagctggtggagatggccaattactatgctctttcccaccaacagaagagccgtgccttctaccgtatccaagccactcgtatgatgactggtgcaggcaatatcctgaagaaacatgcagcagaacaagccaagaaggcctccagcatgagcgaggtgcacaccgatgagcctgaggactttatttccaaggtcttctttgacccatgttcttaccagtgcctggagaactgtggggctgtactcctgacagtggtgaggaaagggggagacatgtcaaagaccatgtatgtggactacaaaacagaggatggttctgccaatgcaggggctgactatgagttcacagagggcacggtggttctgaagccaggagagacccagaaggagttctccgtgggcataattgatgacgacatttttgaggaggatgaacacttctttgtaaggttgagcaatgtccgcatagaggaggagcagccagaggaggggatgcctccagcaatattcaacagtcttcccttgcctcgggctgtcctagcctccccttgtgtggccacagttaccatcttggatgatgaccatgcaggcatcttcacttttgaatgtgatactattcatgtcagtgagagtattggtgttatggaggtcaaggttctgcggacatcaggtgcccggggtacagtcatcgtcccctttaggacagtagaagggacagccaagggtggcggtgaggactttgaagacacatatggggagttggaattcaagaatgatgaaactgtgaaaaccataagggttaaaatagtagatgaggaggaatacgaaaggcaagagaatttcttcattgcccttggtgaaccgaaatggatggaacgtggaatatcagcgctcctgttatctccagacaggaagctgactatggaagaagaggaggccaagaggatagcagagatgggaaagccagtattgggtgaacaccccaaactagaagtcatcattgaagagtcctatgagttcaagactacggtggacaaactgatcaagaagacaaacctggccttggttgtggggacccattcctggagggaccagttcatggaggccatcaccgtcagtgcagcaggggatgaggatgaggatgaatccggggaggagaggctgccctcctgctttgactacgtcatgcacttcctgactgtcttctggaaggtgctgtttgcctgtgtgccccccacagagtactgccacggctgggcctgcttcgccgtctccatcctcatcattggcatgctcaccgccatcattggggacctggcctcgcacttcggctgcaccattggtctcaaagattcagtcacagctgttgttttcgtggcatttggcacctctgtcccagatacgtttgccagcaaagctgctgccctccaggatgtatatgcagacgcctccattggcaacgtgacgggcagcaacgccgtcaatgtcttcctgggcatcggcctggcctggtccgtggccgccatctactgggctctgcagggacaggagttccacgtgtcggccggcacactggccttctccgtcaccctcttcaccatctttgcatttgtctgcatcagcgtgctcttgtaccgaaggcggccgcacctgggaggggagcttggtggcccccgtggctgcaagctcgccacaacatggctctttgtgagcctgtggctcctctacatactctttgccacactagaggcctattgctacatcaaggggttctaa

SEQ ID NO: 6478 - DNA, 4428 bp, Homo sapiens
aaatggattttggtgtgatatcagttggtagtactgtccctggcaaacagacgcataactgtgcattgttctttgggattttgagagccttcatctcaatttcaactttaaagcagcttaatctttaaggaacatatctctgatctgggtaatttgtagaacttaatttgagggtcattacatgtgaggatagcaggagttgaagatgccaaggacctgaagggctactggagggacaggtgaagtgatttgaagatgtagcattttgaatctctttctggcccatcctctgcttcacaccagaatcattgtgacctgtagacctgcaaaacaaaggaccaaaggttagcatgcagaagtgaaagtgtcaataataaccaaaccactccatcaagttaggtctggggaaaagcagcagcaaaaatgagttcttacttctgggcacaaaatgaaagtaacagacctgatttactctgcgggcagccagctgactaccttgttgaagagaaacatttcacaacgcttgtatgcttcattgttgttttgggagggcttttgaagatgtgtttaaagaattgtgaagtcattgttttgacgattctttctctatcaggattcgtgataggacacatggcctacaattctgttgaggtgcaccaaattgtctaccctcttctaagaacatcaagtttttcactttattcttacttttcacctttaattatatttatggttgctttggatgtagaattttatacactcaagaaaatgttttggcaggtcttgttaactggattaattagcttttctacagcaagcatcataattggatatgtcgttataaaattcaataaagattcatgggatttgcaatcttgcctactctttagcatcacccttggcattatagatcctcttcgttctgtgaattcactaaaaactattggcatttctaaaatatacattgatctcattagaggagaatcattgatcatttgtagcatcgcatcaattttttttggaaattttcggggcaacagaatccacttttctatttttagagatttacatgtaggcattgaactcagctatgacattttgggaagcataatatttggatattggtgtgcaaaaatcattcagtgtatattggctgacgtttttagcaatatgctgactaatatcattctctgcttttcaatggtgtacatgactttctatattgtggaatttttaggaatgtcaggcactcttgccttagccgctgtaggactgaatttagattctttaacttttaaaccgaagatcgaacttgtaattactaagttcttaagaattttttcatctgtatatgaacatttaatatatgctttctttggcattgtgattggatgtggagaactcagccactatgaatttcacactatacctttcatattcattttatttacaacagtgaatttggtaaggttgcttactattttgttagtgagccctattttgatgcattcaaattatgaatataattggcgatggggagttgtaatcacgtggtctggaattaaaggagtttttaatttactctgggctcctgatgtttataatctcgctgaacgaaaagtggaagtaccacaaatgtttatactctatgtacaagtaatatcattattgacaatgggaataaattcatacgtgatgactcagtcagccaggaagttagatttgtgtgttctttccctcccaagacaaatgatcttgcaaaatgccactcagcacatacaggagatagtacagaacacaataactttatttaaaacagaaaaaattttgacaaatgttaactggaccttagtagaagataaaacgaggatcgaatacattcctttttcccacgtttcacataatgatatgaagacagaatccacaacagatgaagctttaatggaggaagccagattgcatgtagctgcaatacaaatgagtagctttgaaaaacagcgtaacaatggaattcttgaaatagaggcagcccggatattaattggtgcagcaaaatgctattactccatccaaggaaaattcatgagtatttatgatgtttcaacttatatgagaactagaagttggcttataaagtttaaaaatgttttaactttcttggaatattgtatagaaaagatacattttattccacctgagagtaatacatttctgacttttatatttcacatagtattttctgaagaatttgaatatacaggacagattataaatttgatatatatttatcctatgataatacatctgtggccaatggcaagaggtttaaatgtatcagcactgatatcaataaactactattttatgtttttatatgtattagaatcaacattgaagataataattttgaaaaggaaatattttcaacaatgttggaatactttggaattttttatcctggttattggaatcattgatatcttttgtgtatactttgtgaaattgagaccagacaacttggctcttatacagcttacagtaataatgggatatttaagaataattaggtttcttcctctcttcaagataatagtaccaatactgataagaattgcagatgtgcagatcaaaaagcgcctcagcttgatgtatagtattacaaaaggctatatcaaaagtcaagaagatgccaaacttctaataaaacaaatagctgtctgtgaatcaatatatcagaaactatgtgaaattttggaaaccaacaaacaggatgctgtcaaagaattagtactcatggagcatgagggtcgtgatgttgtcattgctttgaagactaaacaggcaatccggaatgtgattgctaaagctctaaaaaatctcaccttcctttgttcaagaggcattattgataagcatgaagtcattgagataaataaggtacttcttaaaaaattaaaagcactaaataactttccaaaggcaatcccacccccaactcctgacatataccttcacaacatcatttggctggaaggtaaagatgttctcattgacttcttcaaggaaagagccaaacttgcctgttttgactctggagataccatttgtaaaggaggtgaaatgccacaaggaatctacttaattatttcaggaatggcaattttgcatagtttatctcctacctttggaatagagagtaatcaaaggtgtgatagagggtccagagacatgtttacagagttctgtactactggggacataattggagagctaagctgtctgcttaagcgtgaaattgaatataccgtcatctgtgaaactagtttacaggcctgctttatctccctggaggatttatatgaaggctttgatgccttctggccatctctggaatataaaatatggctaaagcttgctctcagtactgcctatcagtattttgaatcaagtcttattgatgaggacttaaggtttcagaactgtgtgatgttcaatcaagcatatgtggaaactttatcaagctatagtgacatgattattgataatatgaccatgaaatttgttatcattgtgtatggcagtgtaattgatactaagacagaggaaccatattttgcaccttgcattatacctacaacctgtgagcaggttcagggaacttctgatttaagcaagctgctgataatccaagcatctgagcttacccaaagaaatagtaacaccaatgtcatggcctcagtcaacacggtctttgaacaaccaggaaagaatataaatggaagacaaaagatgagttgaaaactggataccattttagaaaagggtattaatgatacaaatatgatgtgtggagtcaggttaaagaccaaactactttcctcgctcaaatactaaaggattatctgcaaggagtttacttagaagctactgaaacaggttactgctgcatttagtttataagcaatggatggacttctgtaaaacttcttaattttaagtagttgcattatatttgggatgttaaaaaagtcttcaggataatataaaatacactgaaacatatgtcctaccaaatgaaaccctgtttccagctaagagcaaattttaacatagtgcattataaaaagtgttgtataactgatatgttactctctaaagcatagaacctgtaattttcatttgtgaaattgttataattagtgcctccctaatattttcccgagtatagctattctccccttcccagtttggtaaatattgaaaaacagaattatattccacaatcttagtaactttcagtaagtaagtaacttttgctttcagtgaaatttaggagaaattaatattctcatattgcatagtactgtttgatgtcacctttcattttatttttaaaaatcaaataaagttgagttttatggttgtcta

SEQ ID NO: 6479 - DNA, 2237 bp, Homo sapiens
aaacagacgcataactgtgcattgttctttgggattttgagagccttcatctcaatttcaactttaaagcagcttaatctttaaggaacatatctctgatctgggtaatttgtagaacttaatttgagggtcattacatgtgaggatagcaggagttgaagatgccaaggacctgaagggctactggagggacaggtgaagtgatttgaagatgtagcattttgaatctctttctggcccatcctctgcttcacaccagaatcattgtgacctgtagacctgcaaaacaaaggaccaaagccagctgactaccttgttgaagagaaacatttcacaacgcttgtatgcttcattgttgttttgggaggtgcaccaaattgtctaccctcttctaagaacatcaagtttttcactttattcttacttttcacctttaattatatttatggttgctttggatgtagaattttatacactcaagaaaatgttttggcaggtcttgttaactggattaattagcttttctacagcaagcatcataattggatatgtcgttataaaattcaataaagattcatgggatttgcaatcttgcctactctttagcatcacccttggcattatagatcctcttcgttctgtgaattcactaaaaactattggcatttctaaaatatacattgatctcattagaggagaatcattgatcatttgtagcatcgcatcaattttttttggaaattttcggggcaacagaatccacttttctatttttagagatttacatgtaggcattgaactcagctatgacattttgggaagcataatatttggatattggtgtgcaaaaatcattcagtgtatattggctgacgtttttagcaatatgctgactaatatcattctctgcttttcaatggtgtacatgactttctatattgtggaatttttaggaatgtcaggcactcttgccttagccgctgtaggactgaatttagattctttaacttttaaaccgaagatcgaacttgtaattactaagttcttaagaattttttcatctgtatatgaacatttaatatatgctttctttggcattgtgattggatgtggagaactcagccactatgaatttcacactatacctttcatattcattttatttacaacagtgaatttggtaaggttgcttactattttgttagtgagccctattttgatgcattcaaattatgaatataattggcgatggggagttgtaatcacgtggtctggaattaaaggagtttttaatttactctgggctcctgatgtttataatctcgctgaacgaaaagtggaagtaccacaaatgtttatactctatgtacaagtaatatcattattgacaatgggaataaattcatacgtgatgactcagtcagccaggaagttagatttgtgtgttctttccctcccaagacaaatgatcttgcaaaatgccactcagcacatacaggagatagtacagaacacaataactttatttaaaacagaaaaaattttgacaaatgttaactggaccttagtagaagataaaacgaggatcgaatacattcctttttcccacgtttcacataatgatatgaagacagaatccacaacagatgaagctttaatggaggaagccagattgcatgtagctgcaatacaaatgagtagctttgaaaaacagcgtaacaatggaattcttgaaatagaggcagcccggatattaattggtgcagcaaaatgctattactccatccaaggaaaataataattttgaaaaggaaatattttcaacaatgttggaatactttggaattttttatcctggttattggaatcattgatatcttttgtgtatactttgtgaaattgagaccagacaacttggctcttatacagcttacagtaataatgggatatttaagaataattaggtttcttcctctcttcaagataatagtaccaatactgataagaattgcagatgtgcagatcaaaaagcgcctcagcttgatgtatagtattacaaaaggctatatcaaaagtcaagaagatgccaaacttctaataaaacaaatagctgtctgtgaatcaatatatcagaaactatgtgaaattttggaaaccaacaaacaggatgctgtcaaagaattagtactcatggagcatgagggtcgtgatgttgtcattgctttgaagactaaaca

SEQ ID NO: 6480 - DNA, 1879 bp, Homo sapiens
gccccgccccgcccctgcgcggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacaggctgtgttaggtcctctggctctagaaacagcaagagtctccgcaccccacttggaaccatatgcgaaggatgtgatgacagtagcatttttagccatcttgatcacagctccaaatggagctctacttatgggcattctggggcctaaaatgcttacacgccattatgatccaagcaaaataaaactgcagttgtcaacattagaacatcattaaaaagtttacctgtcatcatctgcctgcttcttttaatgaattatttcacatgacagaagaattttaaagtagaaatatgtggggactgtacagagaatccaggatttagtaaacatgtgatttcagtacagggcttttcttggactttttactccaaagttaatttaataaaaataatattaaatggaa

SEQ ID NO: 6481 - DNA, 1735 bp, Homo sapiens
ggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggttttgttctaggtgctgtctctcctgctgttgttgtcccttacatgatggtgctgcaagaaaatggatatggtgttgaggaaggcattccaaccttattaatggctgctagcagtatggatgacattctggctatcactggattcaatacatgcttgagcatagtcttttcctcaggtggtatacttaataacgccatagcctctataaggaacgtatgtattagtctgctggcaggaattgttttgggattttttgttcgatattttccaagtgaagaccagaaaaaacttacattgaagagaggattccttgttttgactatgtgtgtttctgccgtcttaggcagccaacgtattggtttacatggatctggaggattatgcacactagtgttgagtttcattgcagggacaaaatggtcccaagaaaagatgaaagtccaaaagattattacgactgtatgggatatttttcaaccacttctttttggtttagttggagcagaagtatctgtttcatcgcttgaatcaaatattgttggcatatctgttgccactctaagtttggcattatgtgttcgaattttaaccacatatctattgatgtgctttgctggttttagttttaaggagaaaatatttattgctttagcatggatgcccaaagctacagtacagattaatcaagctatccttctgttgtttcttcttcgggaggaatggacgaactgcaaggtagccaagaagtgcgagtacaccaaggaaaggcaataaccgaagccattctgaaactaaacatgtagatgtgtcagaatctgcagtgctcttggaaaagaattcaaaatagcatgtctagtttcatccttgagcttattctttgttactttttacattaattcctttttaatggatccataaaactgtgaataaataacacaataaagccagctctaccaaag

SEQ ID NO: 6482 - DNA, 782 bp, Homo sapiens
ggaagtctatccgggctttcgcgtcaccaccctgcccacctgggtggcgcgtggcttacgcaacggtcactgggctcctgggccgctcccgggccagcgagggctgcgaaagaagttgtagcatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagacaaaaaaggagacatacatttcttgtcctctaagaggagtattgaatgtaattattacaaatggagttatactgtttgtgatatggtgtatgacctggtcaatcttaggctctgaagctctccctggtggaaatttatttgggttgttcattattttttatagtgccattattgggggaaaaattttacaactcattagaatacctttagtgcctccacttccacctcttcttgggatgttactggctggttttacgattaggaatgttccattcatcaatgaacatgtccatgttcctaacacatggtcttcaattttaagaagcattgcccttaccattattctaataagagctgggcttggactcgatccacaggctttgaggcatttgaaggtcgtttgtttcagattggctgtaggtccatgccttatggaggcaagtgcagctgctgttttttcacacttcattatgaaatttccctggcaatgggcatttctattaggacttttt

SEQ ID NO: 6483 - DNA, 568 bp, Homo sapiens
acctgggtggcgcgtggcttacgcaacggtcactgggctcctgggccgctcccgggccagcgagggctgcgaaagaagttgtagaaatcaaaggtaatttgaggcttcagctctgtgcagagtgcaaggaaccaaagatgcaaagttgggagtcaccagcatatggaaaactacctagggcaagtgtgctcaccgataacattgcagtgactagtgtaaagcagaggaaaagaagccaacaaaagagatggaagaatagccaatgaagtaggaagaaaatctgaagagtgcagtgacataaaagccgagactggccgggcatggtggctcatgcctgtaatcccagtactttgggaggctaagatgaggaaattgagactcagagaggttaagggtcttgacgaaggacatatacctacatgcataccacagaatcaaaaaatgaacatttggaggatgaaaacttccaaacatctacaactcctcagagtctcattgatcctaataatactgcacaggaagaaactaaaactgtcttatcagatacagaagaaataaaaccacagac

SEQ ID NO: 6484 - DNA, 2237 bp, Homo sapiens
gggcaggtgttaagcgataaaggggggcagaacaagtcttttatccggccatttaattggtcaccttaagaaagaatcctatcttcccaccgcagctgagaagacacttctaagaggtacagctaaaaggtggaggactgatagacaacttagaggttggtttcgggaacgataaaacaagtaacgggctgcccggcctgcgccgcggagtcccgaggagcctgcgctgtgctcctctcgcggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggaagcgcggattctattactggaaactttgggactgaaaggccaaagcttctgggcccaccatcaacgcagctccgctttcatttctttcacatacaactttccacataa

SEQ ID NO: 6485 - DNA, 2300 bp, Homo sapiens
gaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggaagcgcggattctattactggaaactttgggactgaaaggccaaagcttctgggcccaccatcaacgcagctccgctttcatttctttcacatacaactttccacataagatttcatgcggaaaaaaaaaaaaaactcacaaaggttttatactgataacagtatattaagtgtttactttgtacacagcgtctttgttccagacacttgccatgtctcatttattctcacaccaccaccacagcgtcctttacagatgagaagacaacctcagggagacgatgtatttgcctaggtcccatagctagcaagtgacagcgctgcagtttaagctcaggccgtcttggggagagaccgtgctcttctaccattgcactttaagctgactttaggggaaacacaatctgagttttgacaagtttacttctggcacatgcagtcccgagcactgctttttggctaaaatgcccagtgatgtcaactctgtccctggatttctacaacccgatgagtcaatattc

SEQ ID NO: 6486 - DNA, 3126 bp, Homo sapiens
cggtgtctcgtcatctccgggaagactcggcgcctgggtccgcgctctctgggtaagctttccgggaagctttcccgggagctcgctggtcctggccccagaagcctgcggacccgcccagggaggataagcagctgaaagaccgcgcggtgccgctccgaggccccgggacgtgggcccatggtcggcctggcgccacctttccgggggaagccacgcgcaccaggcatcgcacgcggctctgcacccgcgccgccggacctgaaacccggcggagggcacacggggctgccgctgcgggccccggaccaacccatgcttactccggagcctgtaccggcgccgacgggtcggacctccctgcgcggtgtcgcccagcgggttcgtgcgaaaggcggggccgactacacgcggtgccgcgccctgagaccgtttatctgcagtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactgccttctcttcttggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgtttttgttgttaaacatcataatgcagtctctcattaatttttaccatcatttaccctgataatctgcctcttctccatttctccttcccttactacctttctttgaattactgtaactgattggtcccaccaaaattttaaagtacatgaagtatcttcattggttcatcctcttgccccctccagatgtcaaaaaactttatcctgccccctagctgaccacccaggttcctttatttcagtggcccatgtgagtctaccttcccctaaggagtgccctaatccagccctttttttgtttcttatgacccatatctttaggctcttcccatttctaggtgggagataggtaagtttcaaatctatgccagtcttatgaatattacattagggtaatgtgctataatgaagaaataaaaaatacagtgcttaaaagaaaataaaattctatttctgtctaatgaaa

SEQ ID NO: 6487 - DNA, 1911 bp, Homo sapiens
agtcaacgcagcctcccggctcagcctgggaagatgcgcgaatcgggaaccccagagcgcggtggctagaccgggctccgccgcctcccccacagcccctttcctaatcgttcagacggagcctggtcgacttcgccggagactgccagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttcaaacaccccttcatcatccatcttaatttgcataaggacatatctactttaatgtactaccacagtttacagttaatgtgggaaagaccagcttcagtatcctcttcagctaggattgccctaacttttaactttcacagtttcctgattcatatttgcccaggctctgatgccttgaattggttttggctctcttttttggatctgt

SEQ ID NO: 6488 - DNA, 1826 bp, Homo sapiens
aataggttcatcacaaaagaggacctgagagacaagaatgaatggtttctgactggtggagaaatttgaggataatctcccttgcttgaaaagcggtgattaagattggcacttgcttacaggagtgaaaaacagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatggcatgctgcttgcagggtttctcatcagaaatatcccagtcatcaacgataatgtgcagatcaagcacaagtggtcttcctctttgagaagcatagccctgtctatcattctggttcgtgctggccttggtctggattcaaaggccctgaagaagttaaagggcgtttgtgtaagactgtccatgggtccctgtattgtggaggcgtgcacatctgctcttcttgcccattacctgctgggtttaccatggcaatggggatttatactgggttttgttttaggtgctgtatctccagctgttgtggtgccttcaatgctccttttgcagggaggaggctatggtgttgagaagggtgtcccaaccttgctcatggcagctggcagcttcgatgacattctggccatcactggcttcaacacatgcttgggcatagccttttccacaggctctactgtctttaatgtcctcagaggagttttggaggtggtaattggtgtggcaactggatctgttcttggatttttcattcagtactttccaagccgtgaccaggacaaacttgtgtgtaagagaacattccttgtgttggggttgtctgtgctagctgtgttcagcagtgtgcattttggtttccctggatcaggaggactgtgcacgttggtcatggctttccttgcaggcatgggatggaccagcgaaaaggcagaggttgaaaagataattgcagttgcctgggacatttttcagccccttctttttggactaattggagcagaggtatctattgcatctctcagaccagaaactgtaggcctttgtgttgccaccgtaggcattgcagtattgatacgaattttgactacatttctgatggtgtgttttgctggttttaacttaaaagaaaagatatttatttcttttgcatggcttccaaaggccacagttcaggctgcaataggatctgtggctttggacacagcaaggtcacatggagagaaacaattagaagactatggaatggatgtgttgacagtggcatttttgtccatcctcatcacagccccaattggaagtctgcttattggtttactgggccccaggcttctgcagaaagttgaacatcaaaataaagatgaagaagttcaaggagagacttctgtgcaagtttagaggtgaaaagagagagtgctgaacataatgtttagaaagctgctacttttttcaagatgcatattgaaatatgtaatgtttaagcttaaaatgtaatagaaccaaaagtgtagctgtttctttaaacagcatttttagcccttgctctttccatgtgggtggtaatgatctatatcaccaaccttaatctctctgccttttttttc

SEQ ID NO: 6489 - DNA, 648 bp, Homo sapiens
atttcagatgatctgaagaagggtattggatggaacctatccaataggttcatcacaaaagaggacctgagagacaagaatgaatggtttctgactggtggagaaatttgaggataatctcccttgcttgaaaagcggtgattaagattggcacttgcttacaggagtgaaaaacagatctcgttcctcttccctgtgtcatcttcttaattataaataatgggggatgaagataaaagaattacatatgaagattcagaaccatccacaggaatgaattacacgccctccatgcatcaagaagcacaggaggagacagttatgaagctcaaaggtatagatgcaaatgaaccaacagaaggaagtattcttttgaaaagcagtgaaaaaaagctacaagaaacaccaactgaagcaaatcacgtacaaagactgagacaaatgctggcttgccctccacatggtttactggacagggtcataacaaatgttaccatcattgttcttctgtgggctgtagtttggtcaattactggcagtgaatgtcttcctggaggaaacctatttggaattataatcctattctattgtgccatcattggtggtaaacttttggggcttattaagttacctacattgcctccactg

SEQ ID NO: 6490 - DNA, 3725 bp, Homo sapiens
agacaatgagggagagtctccgccgaccgcctgctgcttattgttccgggactggagactgcagccggctgctgcctagtcctccggggctccgctcctgactagctcctccgtccctctagggacggttcggggtcacctaaccctggtccccggggcgctgggacgctagccccaagccgcagccgctcttcgctgaccgccctctttctgctttgcaggtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcagcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctg

SEQ ID NO: 6491 - DNA, 7682 bp, Homo sapiens
ctcgctgctgccttgcagtttgatctcagactgctgtgctagcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatggtgctgtagaaatctttgcatattgctatgggcttccaagaaaaactacctcgaaggaaaacaaagacaagatgacgatcattctaatgagaagaattataatatgacatgcacactctttacaaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggggcagaggacataatgaggttagttcttacggattcaaggcagatagtgttggtgaaacagtgagtgtcaaaattaggcgaggtggtgactgggctccctgatgacctcttgtcgtggagcaaaactgaataagcaaaaacttactcaagctcctgaggcccattcatcatccctattgatagatttgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggacagacatggagaagagaaacaagagaacaggtagtgagaagtcgagagtcagtaattttcttacttaatattgtggggatcttacttaatacataaagttaatgaaactagaaatagtggtttaatatattacttataattcaaaaattaacctatatttacagatgcttacacagtttctttgtgaatccacctatggttttattttaattaattttttattgcaaagcaatgaaatgttgctttgtggagccagatagcattacagcaggtaaatgggtttctgctagatctccacattattggggagatgctcgaagacctcagaatatacacacccttaaggttcaagggctggggttgagctctccataaggaacttttcctcctcccagaagggcgatcattgtgtatatagacatggagacagaaccagaatgacttctgtgggtggaaatagtgccatcagaatcatttattattatgaaataaatattatttatctacattgaaaaaatactactcctcctaaaatcattaacttttcctcagatgattttaagaaatttgagtaatagcacacgaagtggtaaagacccttagtctttctggtatattagaaaagccttttaatcagtctctggaaggacactagggattgcagctgaataaatatattaagaataacaaatcagttcaacaaggagtagagtctgaagtgggattttccgtggaaattctcttatgtctgtactaacaataagaaagacaagacaaagactaagtaattaaagaaaagctcgaaatgttttgtaaccaaaagcttgaaatgttatgtaaccagaatgttatgtaaccagagctgttagatcagatactggctgattcataggtgaacgtcctctttgtgggtcctctcatgcatccccattttcagaatgtaaataatttggctttgtagcccttccaaaaagggtactatcccacttctcctggcataaatcatacattgactgaacgttcaccatctaaaaatcactcatgctccttgaaccaaggtgattatcagagacagctcctggtagaagaggttgtagatgttaaaagagtatgatttctatataagaaaatatagaaattgacagaatggttcttatttactgggcctggagaattcctgttctggcattcttagatccctcaaatttattaccaaggggaaaaggaaaaagaggcaagtaggcagtagggtaagctgttgtttgcttgccaaggaactggagagtgcaggtttcaagacaccttgaggaaattctcctgagcccttagccaagagaagagagcagaaaatgcttttctgtagaatcccaagaggcataaaagaggatgagtaactgggtcctgtgccaagttcccaacccctaagccttcccaacatggagaaactacaccagtgtttaaaagtttctaggttggaggaacaaacttgagcatcaagggcagatgatttgttaacacagtcctgtgcagagggctccttcagaaggcatcccctgtgacccaaacacagtgagcaccttctactttctggccttatgccatcaatgcatccagctgcaatctatcctcaaacctggaatccatctcttgacttcccagccagaccaccttccatcccttcactgtgtcccaccctgcccagaatgcatgctgttctcccagagtctcatggaaataaggccttgcactgaaataggctgtgggaaacaaaaggataagcaggtctggaccagtctgtaatggtagcaggtgaaaacaacttacggaaaaacacatgaattcattaggaaataaggtgacagatccccagctgctgaagaactagaatgtctattacactcatacaattgatgttttattttaatacaccagagctaccacacaaaacttccttccatgtgaaaggctccagataaaattctgccatccctcctctcctcatgtcctcctgctcagacccaccttcatgcccctaaaccaatctgcatcatgcctgtttcagagagtcatgggaagatgggcagtgcctccattgtcaccattccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgttta

SEQ ID NO: 6492 - DNA, 1978 bp, Homo sapiens
gcttggaacaccctgaagagcaacatgggagaaactgagaaaagaattgaaacccatagaataagatgtctttccaagttgaagctgagaaaccctgaaaatactctgtcctgggcttatatgccttagacacaactgggattgctgagctcaagggttgcagagcatcctactatgggaagaatgaggacataactcagattgttctggatatttccctcattgctgagaatgcagaatgtttctgaccaagaattgcaagcaagaacaggaaagagtggagtcggccaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttggtaaaaatagttattttttcccacatcctatcagaacaatattattattattattttttattacactttaa

SEQ ID NO: 6493 - DNA, 356 bp, Homo sapiens
agcaatcagcgagactccatgggcgtaggaccctccgagccaggtgcgggatataatcttgtggcgcgccgttttttaagcctgttggaagagcgcagtattcgggtgggagtgacccgattttccaggtgctgtagaaatctttgcatattgctatgggcttccaagaaaaactacctcgaaggaaaacaaagacaagatgacgatcattctaatgagaagaattataatatgacatgcacactctttacaaagggtagaagtaagacatatcaagatttaaaacataaatagcttggaacaccctgaagagcaacatgggagaaactgagaaaagaattgaaacccatagaata

SEQ ID NO: 6494 - DNA, 702 bp, Homo sapiens
agcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatgaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattc

SEQ ID NO: 6495 - DNA, 448 bp, Homo sapiens
ttatttgatgtaccttttgaaatagaaaaccaacaactaaatcttctctaacaccatgattttctaatctgtattaaagcgttccagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctg

SEQ ID NO: 6496 - DNA, 580 bp, Homo sapiens
gatgtaccttttgaaatagaaaaccaacaactaaatcttctctaacaccatgattttctaatctgtattaaagcgttccagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcag

SEQ ID NO: 6497 - DNA, 559 bp, Homo sapiens
agcaatcagcgagactccatgggcgtaggaccctccgagccaggtgcgggatataatcttgtggcgcgccgttttttaagcctgttggaagagcgcagtattcgggtgggagtgacccgattttccaggtgcgtccgtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatgggtagaagtaagacatatcaagatttaaaacataaatagcttggaacaccctgaagagcaacatggg

SEQ ID NO: 6498 - DNA, 562 bp, Homo sapiens
gagactccgtgggcgtaggaccctcagagccagtgagatgaacccggtacctcagatggaaatgcagaaatcacccgtcttctgcgtcgctcacgctgggagctgtagaccggagctgttcctattcggccatcttgggggagctcgagattattaaccaaaaaatttcctgtccaaaagctgtgttctttagtgggaaagtcttgcagaactcccctctgaactaatactggaagcaaagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatg

SEQ ID NO: 6499 - DNA, 569 bp, Homo sapiens
aagattataacctgctttatgcaaccatcagagccaaagaaacttaaccaaaggtttaaaacttacataaacaaagattcttttatttacaactctgcttctctgatgaacaagaagctgcagcttacacgtttgaggtgccttattcatactggctactcaatatgtaattttttaaaaaatctgttggtcttacagtatggaagcaaaaatgaatggtgatgttggtgaatgctaagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcatt

SEQ ID NO: 6500 - DNA, 7211 bp, Homo sapiens
tttgaaatagaaaaccaacaactaaatcttctctaacaccatgattttctaatctgtattaaagcgttccaggtatttttgtaatgcaatggatttcaattatgttgttcattttcagcacttacttcaaaagaatgatgctttacaattttgtagttaatttaacatatttttttgtttgcttgaaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataataaaatgttcactaatgatatttctaaggtatcagtgacacttgagttttcctaggagggacatcaataacagccccctaaagaagattcttagagccagctttatttttatgttgaaacagcaatttcccttaattcatcgaagtaagggtgtacttcctacatctccttctactaatacttctaaaaattttctgttatgaaaacctatttaattccactaaatttgttctttgatattggaattattcagatgcctaaattctcattctgttatgtgaagatttaaatattttattcaagtttatcgcttccatgtgagagaagcctacatcttcttattctatttaggaatcgttctttaactcttcttattcattctaggcatgactcctatataatagattactcataaatataccctcctactttcaattttttcttttctttattactcatacatttgctcaatttgtacagaatactgacaaacttaagcaggttattaaacatcatgaggcaaagattgttggattttttttcagtaattcaaatccagtgactaaagtttttcttacaaacaagtgtctgaatcaaaggatgaaaggacaatattataaaaactccagttcttaaaggctgtttgtaatgtcagatattgtcaaagaaccactttctaagattcaggactctttagaccgatgtttatatcacccattgtgtcctaaggtagaacacaaacactaattttcccaaaataatcttagacaatagcttctgttatgaaacagaggttagtaaaggctaaggtacatattaaaagctaaatctacttatattattattttgtaaattatggataaaattaaaaattgaaggattttagacatagaagaggacttattgattaatatagggcttctggtaaaagagaatagaatgaacagacaaatacctgtttgtctactccttactctccttcctgttgaaatgacagtcaatatataagaatgacataaatccctaatggatgaagagaatggagtaaggaagggtgggagaagtgggtgtcaatacactatggttatttatgtgtactataaatggagtgagagtgtctgcagggatacaacagagtggaggaagctgaaatacagaatatacctagaaggagcctggaatggaagtgtgaaactgagttgccagttcaaagtgtgagttggtagctggacagaaagcaggccagttaactgaaggactttgtacagatgctttacaggttaatatgatttcctaaatgatcagatgcatcatatgaaaaaagaaagcaaatgagaagagaaaggctgtatagaacaggtttagggggaaggatgaaaagttaagtttcagtttcatgaagtttgagacttcaactctgggcatataaaaaataaccaaggttcaaaccaagactggctttgaaacaagagagaggaactaaaatcattggaaagggggagtttaactttgatgtaggtatgactgcagcagtgagatatcgtattaagatctgatgacatgaaatttggagccacttcctttgtggtgggaggaagtgaggagaatggcctggaaactaaaacaaggagaagagacttacctatattcacagagcagcaagaaaaagtaaacagccactgcatgagaaggtttcaggggaatcagattttgctgagtgtgcgatggtgaagagaatgctcatttctgaactggaatctgagctaaaaagaagcaaataggatatatatggaagttagacttatggaaattagaagaaggggaatgagagatagtttggaattctgtggctatttaggtgactgacataaatgggggcagaggacataatgaggttagttcttacggattcaaggcagatagtgttggtgaaacagtgagtgtcaaaattaggcgaggtggtgactgggctccctgatgacctcttgtcgtggagcaaaactgaataagcaaaaacttactcaagctcctgaggcccattcatcatccctattgatagatttgaggtgatctgagaaagctgagtcttgctttgtggacaattcacccacttgaactccctcaatggagcatcataggcccagagagacatggctatggacttagtaccttggcatcacttttatcccctcatggaggagatggcattttactctgaaaacatagggttctcctttgacacttcttggtgggagaaagcaggtcagagaaagtgggtgttggagtgctttgggatccctcatgacctcttttgttggtatacatgaagcctgggagtttagttcttattctgagcacttgtactactctcatgagggtagagataatggcatagcggacagacatggagaagagaaacaagagaacaggtagtgagaagtcgagagtcagtaattttcttacttaatattgtggggatcttacttaatacataaagttaatgaaactagaaatagtggtttaatatattacttataattcaaaaattaacctatatttacagatgcttacacagtttctttgtgaatccacctatggttttattttaattaattttttattgcaaagcaatgaaatgttgctttgtggagccagatagcattacagcaggtaaatgggtttctgctagatctccacattattggggagatgctcgaagacctcagaatatacacacccttaaggttcaagggctggggttgagctctccataaggaacttttcctcctcccagaagggcgatcattgtgtatatagacatggagacagaaccagaatgacttctgtgggtggaaatagtgccatcagaatcatttattattatgaaataaatattatttatctacattgaaaaaatactactcctcctaaaatcattaacttttcctcagatgattttaagaaatttgagtaatagcacacgaagtggtaaagacccttagtctttctggtatattagaaaagccttttaatcagtctctggaaggacactagggattgcagctgaataaatatattaagaataacaaatcagttcaacaaggagtagagtctgaagtgggattttccgtggaaattctcttatgtctgtactaacaataagaaagacaagacaaagactaagtaattaaagaaaagctcgaaatgttttgtaaccaaaagcttgaaatgttatgtaaccagaatgttatgtaaccagagctgttagatcagatactggctgattcataggtgaacgtcctctttgtgggtcctctcatgcatccccattttcagaatgtaaataatttggctttgtagcccttccaaaaagggtactatcccacttctcctggcataaatcatacattgactgaacgttcaccatctaaaaatcactcatgctccttgaaccaaggtgattatcagagacagctcctggtagaagaggttgtagatgttaaaagagtatgatttctatataagaaaatatagaaattgacagaatggttcttatttactgggcctggagaattcctgttctggcattcttagatccctcaaatttattaccaaggggaaaaggaaaaagaggcaagtaggcagtagggtaagctgttgtttgcttgccaaggaactggagagtgcaggtttcaagacaccttgaggaaattctcctgagcccttagccaagagaagagagcagaaaatgcttttctgtagaatcccaagaggcataaaagaggatgagtaactgggtcctgtgccaagttcccaacccctaagccttcccaacatggagaaactacaccagtgtttaaaagtttctaggttggaggaacaaacttgagcatcaagggcagatgatttgttaacacagtcctgtgcagagggctccttcagaaggcatcccctgtgacccaaacacagtgagcaccttctactttctggccttatgccatcaatgcatccagctgcaatctatcctcaaacctggaatccatctcttgacttcccagccagaccaccttccatcccttcactgtgtcccaccctgcccagaatgcatgctgttctcccagagtctcatggaaataaggccttgcactgaaataggctgtgggaaacaaaaggataagcaggtctggaccagtctgtaatggtagcaggtgaaaacaacttacggaaaaacacatgaattcattaggaaataaggtgacagatccccagctgctgaagaactagaatgtctattacactcatacaattgatgttttattttaatacaccagagctaccacacaaaacttccttccatgtgaaaggctccagataaaattctgccatccctcctctcctcatgtcctcctgctcagacccaccttcatgcccctaaaccaatctgcatcatgcctgtttcagagagtcatgggaagatgggcagtgcctccattgtcaccattccccacacctctgcacacttctgccccttcccctctagacgccacaacttcacagtcttactgttgtaaatattcctgcacagttagtaatgatcaaatgatcctgtggtcagaggcctctttggcagtgtcttcttacccttaagaaaggtcatgaaatccagaaggggcaacctttccaggagagctttggagtcatttctgtgtgagacactattgcataatcctgtaagattgcttttatatttaaggaatgatgttacttaacaaatgaacaaaaaaaattgcaaataaattttttaacaatgttt

SEQ ID NO: 6501 - DNA, 717 bp, Homo sapiens
gttcccaagattataacctgctttatgcaaccatcagagccaaagaaacttaaccaaaggtttaaaacttacataaacaaagattcttttatttacaactctgcttctctgatgaacaagaagctgcagcttacacgtttgaggtgccttattcatactggctactcaatatgtaattttttaaaaaatctgttggtcttacagtatggaagcaaaaatgaatggtgatgttggtgaatgctaagggtagaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattggaaatcttttgttgattatatttgtgagttattttggaaccaaactgcatagacctataatgattggcattggatgtgtggttatgggcttaggctgtttcttaaaatcactacctcatttcctcatgaaccaatatgaatatgaatctacagtttcagtttcaggcaacttgtcctcaaacagtttcttgtgtatggaaaatggaac

SEQ ID NO: 6502 - DNA, 2008 bp, Homo sapiens
cttttgaaatagaaaaccaacaactaaatcttctctaacaccatgattttctaatctgtattaaagcgttccagggtagaagtaagacatatcaagatttaaaacataaatagcttggaacaccctgaagagcaacatgggagaaactgagaaaagaattgaaacccatagaataagatgtctttccaagttgaagatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataactttttcttgtctttaagaacctaaaaaacctcttaactcaaaataa

SEQ ID NO: 6503 - DNA, 2382 bp, Homo sapiens
gtcacccctttctttgactcagaaagggaactccctgaccccttgagcttcccaagtgaggcaatgcctcaccctgctttggcttgcgcacggtgcgcgcacccactgacctgcgcccattgtctggcactccctagtgagatgaacccggtacctcagatggaaatgcagaaatcacccgtcttctgcgtcgctcacgctgggagctgtgcaccggagctgttcctatttggccatcttggctcctctccccttgttcctgattttaatgggactaccttggttatttcacagcacacttacggtgctttgtgaagtgcctgctatgttactatcatcatcttcctgacaagatgaagtaagacatatcaagatttaaaacataaatagcttggaacaccctgaagagcaacatgggagaaactgagaaaagaattgaaacccatagaataagatgtctttccaagttgaagatgtttctgttggcaataacatgtgcatttgtatccaaaacactgtctggatcttatatgaattccatgctcacacaaatagagagacaattcaacatcccaacatctctagttggattcattaatggaagctttgagattgatatgaatatgaatctacagtttcagtttcaggcaacttgtcctcaaacagtttcttgtgtatggaaaatggaacccagattttaagaccaacgcaggatccatcagagtgtacaaaggaagttaaatcattaatgtgggtgtacgtcctagtaggcaatattgtacgtggaatgggtgaaactcccatcctgcctttgggtatttcctatatagaagattttgccaaatttgaaaattctcctttatatattgggcttgtagaaacaggagctattattggtcctttgattggacttttgttggcatcattctgtgcaaatgtttatgttgacactggatttgtgaacacagatgatctgatcataactcccactgacactcgttgggtcggtgcatggtggtttggctttctgatttgtgcaggagttaacgtgctcactgccattccttttttctttttgcccaacacacttccaaaggaaggactagagactaatgctgacatcattaaaaatgaaaatgaagacaaacaaaaagaagaggtcaagaaggaaaaatatggaatcactaaagattttctacctttcatgaaaagtctttcctgcaatccaatttatatgcttttcatacttgtaagtgtgatacagttcaatgcattcgttaacatgatctccttcatgcctaaatacctagaacagcaatatggaatatcatcttcagatgcaatctttctaatgggtatttataacttacctccaatatgtattggatatataattggtggtttaattatgaagaagttcaagattactgtcaaacaagctgcccacataggatgttggttatccttacttgagtatcttctctattttttatcttttctcatgacttgtgaaaattcttcagttgttggaataaatacctcttatgaaggaattccacaagatttatatgtggaaaatgacatctttgctgattgcaatgtggattgcaactgtccatctaaaatatgggatcctgtgtgtggaaacaatggcttgtcatatctgtcagcttgtcttgctggttgtgagacatccattggaacgggaataaacatggtgttccaaaattgcagctgtattcaaacatcaggaaattcatctgcagttcttgggctgtgcgacaaaggacctgactgttccttgatgctccagtacttcctaatcttgtcagcgatgagcagtttcatttattctttggctgccatacctggatatatggttctcttgaggtgtatgaaatctgaagagaagtcccttggtgtgggattacatacattttgcacaagagtatttgctggcattcctgcacctatatattttggcgctttaatggattccacatgtttacactggggaactttgaaatgtggtgagtcaggggcatgcaggatatatgattccaccaccttcagatacatctacctcggattgccggcagcactaagaggatcaagctttgttccagccttaatcatcttaattcttttgaggaagtgtcatctacctggtgaaaatgcctcttcaggaacagagcttatagagacaaaagtcaaagggaaggaaaatgagtgcaaagatatataccaaaagtccacggttttgaaagatgatgaattgaaaactaaattgtaattgtcctattatattacttttttcagaattagagaacatgctgtacaacttaattgttttaaaaatcagtagagatataatagataact

SEQ ID NO: 6504 - DNA, 1918 bp, Homo sapiens
cgcgaatctcctccggccactgccgccgcggtcgcctctcacccgcccggccgctccagcccgaggcgccccgaccccgcgccactccgcgcccggccagccgcccgcagccatggggctcctgcccaagctcggcgcgtcccagggcagcgacacctctactagccgagccggccgctgtgcccgctcggtcttcggcaacattaaggtgtttgtgctctgccaaggcctcctgcagctctgccaactcctgtacagcgcctacttcaagagcagcctcaccaccattgagaagcgctttgggctctccagttcttcatcgggtctcatttccagcttgaatgagatcagcaatgccatcctcatcatctttgtcagctactttggcagccgggtgcaccgtccacgtctgattggcatcggaggtctcttcctggctgcaggtgccttcatcctcaccctcccacacttcctctccgagccctaccagtacaccttggccagcactgccatcttatttgccatctctgtatttggaccggctttcgggtacctgctgggctctgtcatgctgcagatctttgtggactatggcagggtcaacacagctgcagttaacttggtcccgggtgacccccgatggattggagcctggtggctaggcctgctcatttcttcagctttattggttctcacctctttccccttttttttcttccctcgagcaatgcccataggagcaaagagggctcctgccacagcagatgaagcaaggaagttggaggaggccaagtcaagaggctccctggtggatttcattaaacggtttccatgcatctttctgaggctcctgatgaactcactcttcgtcctggtggtcctggcccagtgcaccttctcctccgtcattgctggcctctccaccttcctcaacaagttcctggagaagcagtatggcacctcagcagcctatgccaacttcctcattggtgctgtgaacctccctgctgcagccttggggatgctgtttggaggaatcctcatgaagcgctttgttttctctctacaagccattccccgcatagctaccaccatcatcaccatctccatgatcctttgtgttcctttgttcttcatgggatgctccaccccaactgtggccgaagtctacccccctagcacatcaagttctatacatccgcagtctcctgcctgccgcagggactgctcgtgcccagattctatcttccacccggtctgtggagacaatggaatcgagtacctctccccttgccatgccggctgcagcaacatcaacatgagctctgcaacctccaagcaactgatctatttgaactgcagctgtgtgaccgggggatccgcttcagcaaagacaggatcgtgccctgtcccctgtgcccacttcctgctcccggccatcttcctcatctccttcgtgtccctgatagcctgcatctcccacaaccccctctacatgatggttctgcgtgtggtgaaccaggaggaaaagtcatttgccatcggggtgcagttcttgttgatgcgcttgctggcctggctgccatctccagccctctatggcctcaccattgaccactcctgcatccggtggaactcgctgtgcttggggaggcgaggggcctgcgcctactatgacaacgatgctctccgagacaggtacctgggcctgcagatgggctacaaggcgctgggcatgctgctgctttgcttcatcagctggagggtgaagaagaacaaggagtacaacgtgcagaaggcggcaggcctcatctgaccccaccctgggccactgccctgctccagagagtggaccttgactcttccacacctgcctatactcactaatgttaacacgtcatttcctttttgtattttt

SEQ ID NO: 6505 - DNA, 4494 bp, Homo sapiens
aaaaggacaggctgaggctgagcctcagggaggcggggtgcagcttcctcttcacagagaggctggacttgaacaaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttatattctggtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgact

SEQ ID NO: 6506 - DNA, 4003 bp, Homo sapiens
aggctgaggctgagcctcagggaggcggggtgcagcttcctcttcacagagaggctggacttgaacaaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatcttt

SEQ ID NO: 6507 - DNA, 2368 bp, Homo sapiens
atatctctaaaggataaagtactcccaggaaggctttgagccttggcagaaaaggctgggattgaagcttcagggagagccagaggtgaggctggagtgggagatcacctgaggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaa

SEQ ID NO: 6508 - DNA, 3219 bp, Homo sapiens
ccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgta

SEQ ID NO: 6509 - DNA, 2121 bp, Homo sapiens
caagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggatagaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcag

SEQ ID NO: 6510 - DNA, 274 bp, Homo sapiens
aaacagccatatctctaaaggataaagtactcccaggaaggctttgagccttggcagaaaaggctgggattgaagcttcagggagagccagagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 6511 - DNA, 546 bp, Homo sapiens
attttacccaatccctactcaagatgaagatggagatggagatggggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccct

SEQ ID NO: 6512 - DNA, 224 bp, Homo sapiens
aacgaagaggcacacaggaggtcggagaacacaatatcaacagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 6513 - DNA, 578 bp, Homo sapiens
aactgcagactgggaggttactaagtccttagcagctgagtacagaacacgatggaaatgaaaacatggtacaacagaggttacagccctctcctgacctgataaacttcatgatggagctaaagatggtttgggaagtttctttgaatcacaagcagaactgtatgtgctgtctcctcctgtctggatctactcactacttgctaaagagaagaattttggtttgggataaatttatgtggatcttcgctttggtgccataaagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcag

SEQ ID NO: 6514 - DNA, 2593 bp, Homo sapiens
aaacccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcttcctctcccctgctaagctccaggtcctgagattaaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccatcttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagc

SEQ ID NO: 6515 - DNA, 373 bp, Homo sapiens
atttgggcaaggccccacttgctcccagaagcccagcagggagagcttcataggccatggagacagacccagctgaggagcagctgcagggactccaggagaacgcagccatggcttggggactgcagtacggcaggaagggtgggatggatgcctcctctcggggcacctcacaggacagatgagaatgagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctc

SEQ ID NO: 6516 - DNA, 577 bp, Homo sapiens
agccatatctctaaaggataaagtactcccaggaaggctttgagccttggcagaaaaggctgggattgaagcttcagggagagccagaggtgaggctggagtgggagatcacctgaggcaggtgagcaggctccatgagtgggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccct

SEQ ID NO: 6517 - DNA, 5334 bp, Homo sapiens
cccacgccgcgccttccggttggtccttgaggcgacgggtgaggcacagctgagcgccaaagccacaggctggggcgctaacgcccccgctcagcgctctgcgctccagacagctgcgagctggagtaggaaggttcaggcggtggcggagagtgcgctggaggctggagggccaggaggcgggaagcttcccgcacgggggcgctgtcacctgcctgtgggaggagccagagagggacctggctctgctgctctgaagcaccggagtcgggagaacccatccagacatgaagagcgccaaaggtattgagaacttggcttttgtcccctccagcccagacatcctgcgccgcttgtctgcgtcgccctcccaaatcgaagtctctgccttgtcctctgacccccaaagagagaattctcagccacaggagcttcagaagccccaggagccccagaagtcaccagagccatctctgccttcagcccctcccaatgtctccgaagagaagctccggtcactgtcgctgtccgagtttgaggaggggtcttacggctggaggaacttccatcctcaatgtctccagcgctgcaacacacctggaggctttctgcttcactactgcctcttggccgtcacgcaaggtattgtagttaatggcctagtaaatattagcatttccactgttgagaagcgttatgaaatgaagagttccctgactggcctgatttcatcaagctacgatatttcattctgtttgttgtctttatttgtatcattctttggtgaaagaggacataagccgagatggcttgcatttgcagcctttatgattggactgggagcacttgtattctcattgccacaatttttcagtggagaatataaattggggtctctttttgaagacacttgtgtaacaacaaggaatagcaccagttgtacatcttcaacttcttcactttctaactacttgtatgtcttcatcttgggacaactattgctgggggcaggaggaactcctctttatactctgggaacagcctttcttgatgattctgtgcccacacacaagtcttctctctatataggaaccggttatgctatgtcaatcttaggccctgctattggctatgtattgggaggacaactgctaaccatatacattgatgttgctatgggagaaagcactgatgtcactgaggatgatccgcgatggttgggagcttggtggattgggtttcttctatcatggatctttgcttggtctttaataatacctttttcttgctttccaaaacatttaccaggtacagcagaaattcaagctggaaaaacttcccaggctcatcagagtaatagtaatgcagatgtgaaatttggaaaaagtattaaagattttccagctgctctaaagaatttgatgaagaatgctgtctttatgtgtttagttctatcaacttcttcagaagccttaattactactggatttgctacatttttacctaaatttatagaaaatcaattcggattgacatccagcttcgcagctactcttggaggggctgttttaattcctggagctgctctcggtcaaattttaggtggcttccttgtttcaaaattcagaatgacatgtaaaaacacaatgaagtttgcactgttcacatctggagttgcacttacgctgagttttgtatttatgtatgccaaatgtgaaaatgagccatttgctggtgtatctgaatcatataatgggactggagaattgggaaacttgatagccccttgtaatgccaattgtaactgttcgcgatcatattattatcctgtctgtggagatggagtccaatatttttctccctgctttgcaggctgttcaaacccagttgcacacaggaagccaaaggtatattacaactgttcctgtattgaaaggaaaacagaaataacatccactgcagaaacttttggttttgaagctaaagctggaaaatgtgaaactcattgtgcgaaactgcccatattcctttgcattttctttattgtaattatttttacctttatggccggtactcctataactgtgtctatcctaaggtgtgttaatcacagacaacggtccctagccttgggaatacaatttatggtccttcgattattagggacaattcctggaccaattatatttggtttcacaatagacagcacatgtattctttgggatataaatgattgtggaattaaaggagcttgctggatttatgataacatcaagatggcccatatgctagtagccataagtgttacttgtaaagttatcaccatgttcttcaatggatttgcaatctttttgtataaaccacctccatcagccacagatgtgtcatttcataaagagaatgcagttgtgactaatgttttagcagaacaggatctcaacaaaatagtaaaagaagggtgaaatgggaaaagagaagactgttttacacctggaaaatttacctcgatttttaagaacacacattgccatggcaggattatctatccaatatggacaatcatatttacaaaattgatgtttttataatcaaatgtatttttttacttatgtagtttttgttttatgcaagaaacagacctgtgccttcaaagcccacgtaaagcctcaaaacacagcacacacacacacgagcacacacacacacacacacacgaacacacacacacacacacacacgcacacatacacacttatttcctattcccattgtctaggtatgaaatcctcaagcaataacaagaaaaaaggcccacaattagaaaaatttacatttaaaaaaaatgttgtttctatccccattacaacttgtttaattttaattttcattgtcaatattttgagcttagaacatttatggtataaaaatttaaactaatcaaagttgtgtgatgatttccgggaattattattgaaagcctatgaatttaaaaccaggtttaccatgtaatttgtttttaaatttatgtatactagcctggcctttctccaagcaaattattgaactattagaatatgttagttatcatccttgtgtcttagtatatagtgaatacagaaacatcagcattgtatacacatattttcactttaactcaagaattccaggaggtaatttgttgatattacaatttttaacacatttatgattctgtgataatattattcaattgcatatatttcagaggaaagtaccagtcagtaaagaaaaatgccaactaaacatgaaactattgatcaatacttatatacctttaatttttcctatttgaaaagccaaccacttaacacattactcatagcacctaagacagtgccttgcatagtgtagtcatctattattattgtttaattagaatattaaaccctaccctttaactcagcagtccccaaccttttttgcatcagggaccatttttgtggaagacaatttttccatgggggaagaaggtatggttttgagatgaaactgctccacctcagaccatcaggcattagttagattctcataaggagagtgcaacctagatcccttgcatgtgcagttcccaatggagtgtgcactcctatgagaatctaatgccactactgatctaacaagaggtggagctcaggcagtaatgctcactcacctgcctctcagctcaccaactgtgtggcccgattcctaacaggccacacacagcccagggctggggacccctgctttaactgatgcattgatttgataaagtattttacaagcctgataatgttataaccctgtttattcaggtcagatttatgccaactttgctgagaatatggagggtatagatgagtgaacatcaacaaacataacttctaccatggttaagaattttacttaggaaaagtattgaagttcaaatccagatagtattacatttgaaattgttataagggttattaatttaataaaattcatcatcaggtttcccctataagctttctcctaggttaattttccacaagcattgttttatatacactgtaatcaggataacacaagcttagtgttagatcttgtaggaaaccaagattagaaacattagaaatttgcagaatttaagaaattatgttttgtggtaatctatggccaacgatgttagaacctagcgcaattgtaaagtgaaattcaaggagaaggaatgaggagttagggaagcagcatacttgaatattagagaaggagaggagctgtgggtcaggaatcagagagacctgctaaaaccagacagatataaacaccaaagacggaagccaaataggtagccaaaaatccagatatttgagaagcaggaaatttatagcaaccaaagaaatagggcaagagaggcaggtgaacacacatgatacctcaattgacaatcttcctcccaccaagccagacacgttgtaaatgctgcttcctattggagcccagaaaaaaggaaaaggaaagtttaggctttctttgtcctttgtgtggaagcagggaattggattgaagactttcatagttgtaacataaaggcaaatcctgaggaactcactgatggagatgtgaaatggcagtaaggaagaaaacagaataactgaacaaatatattagtctagggccacttaatttagaggaagaaaaaaaatcaacccatccatagaaatagtttgataaacaggtcactaaatcattggcgtttataaagattcttagctatcaagggctgcattgtattttatatactcagttttataaggtgatactttttaaataagcgctttaatgaaaatggttagactgaaaataattttggtccttaaaaggagtcaggagcttttatatataaggtacatattttaaaagaatacctcctttataacagggttttacagacactaccataatttataatcattattttttacttttgggttcacctagatcatatgagttgatgtgatacttctagaacaaaattattcatagtgcgttttttgtaatttatgattgttaagtaagcttgacttataaattgacattgtaattgtgtacataattggatatatgtgttaaaatttaacatttagatttacttaattgtagaaaatacaaatgtaaaacttacacatggaaagaactgtatgcagttgactttactatgtaaattggagggaaacaaagttttagatccattttctttcaaaattttctttattgtaaagtatgcaaaatatatattcataccatttattaaatcagaatgtttatacaaaa

SEQ ID NO: 6518 - DNA, 3790 bp, Homo sapiens
gtgcgcgtgtgtctgtttggagcggaggagaggcttgggtgacaggcgaggggtggggggaagagttcagcctgagtcacagtctcattcactgatttctcttcggctggacggaggctgcctcctcacgcggctcccaactattcccgtagctcagtgcccccctcccgccgctctactcagccaggcagacagactgacagactcgctagtcggcagcttcactcccgagggtgccgcgagcccaggcggcgaacacccggtacccctggcgcagcgaggtgggatgctgtacggacagcagcgctaagtgcccccccacccccggcgcagggtgcactcgctcctggccgcgggcccagcggcggcggcggcggcggcggcggaggggatgagcccgggacgcgcgaggcgcctgcctcaagctaccgcccggagagggacgccgagtagggctcatcgcagtaccgcgcggacccctgccccctgtggcacgcggctgcggagccttgaagccgtgtctgtgatcaggatgcactgggcgcctcgcagctggtgaggatgccctgctgcgcggccctgcgcccccagccccagtcccaggtgggcaagactgactgggcccggcttcggcccctcgtgccggtggatgaaacgtgccggagtgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagagacctaccaagagcagctgtcaggatcttaagcaacatgacattcctttttgtgagtttgtcatacacagctgagagtgccattgtaactgctttcattaccttcattcccaagttcatcgagtcacagtttggtatcccagcctccaatgccagcatctacactggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaagaaggagacgttcagctagatttgttcccatttccgttgtgttaattcaaagctcatgctcccctacggtacaggctgaggtacacggttagcaaaaccatgggaaggggaatggcggtgcatatcattaactaacactccaaacaaaggtgagcttgcccaggacttggcatttccaaatcaaagtttttagatatgaacacctactgtgagttctgctacaaagcacaaatgaatttgtctcaactatgcaatttgattggaaaaatgtatgtgcagcatgttacatttactttcacggaataaagcagatatgtttctgaaaagaggaa

SEQ ID NO: 6519 - DNA, 2630 bp, Homo sapiens
tgcttgggtgccatcagctatcaaatctgaattctaagcgccatggacgaaggcactggactgcagcccggggcgggagagcagctggaggcgccggccactgcagaagctgtccaagagaggtgcgagccggagaccctcaggtctaagagtttaccggtcctcagcagcgcctcctgccggccaagcctcagtcccactagtggagacgccaacccggcctttggctgtgtggattcttcgggccaccaggagttgaagcaaggcccgaacccgttggcccccagtccctctgccccgtccacttcggcggggctcggggactgtaaccacagggtggacctcagcaaaaccttctcggtgtcctccgccttggccatgctccaggagagaaggtgcctctacgtggtcctcacggattcccgttgcttcctggtgtgcatgtgctttctgaccttcatccaggcgttaatggtctctgggtacctgagcagcgtaattaccaccattgaaaggcgctacagtctgaagagttccgagtcggggctgctggtcagctgctttgacatcgggaacctggtggtggtggtgttcgtcagctacttcggcggccggggtcggcggcccctgtggctggccgtgggtggactcctcatcgccttcggggcagccctcttcgccttacctcacttcatctcgcccccctaccagatccaagagttgaacgcctcggcccccaacgacggcctgtgtcagggtggcaactccaccgccactttggagcctccggcctgtccgaaggactcgggaggaaataatcactgggtctacgtggctttattcatttgcgcgcagattctcattggaatgggctccacacctatttataccctgggaccaacctacttagatgacaatgtcaagaaagaaaactcctccttgtacctagccatcatgtatgtcatgggagcacttggccctgcagtgggatatttattaggtggacttcttattggtttttatgttgatcccagaaatcctgttcaccttgaccagaatgaccctcgtttcattggaaactggtggagtggattcctcctttgtgccattgcaatgtttcttgtgatattcccaatgtttactttcccaaaaaagcttccacctcgacacaagaaaaagaaaaagaaaaaattttctgttgatgctgttagtgatgacgatgttctgaaggagaaatcaaacaacagtgaacaagcggacaaaaaagtttcttcgatgggatttggaaaggatgtcagaggggttattatcgtccccagtgctggtgttggtattgtcctcggaggctacattataaaaaaattgaaacttggtgccagagaatctgcaaaactagcaatgatctgcagtggtgtgtctttactatgtttttcaaccctatttattgttggatgtgaaagcattaatctagggggcataaacatcccttatacaacaggaccttctctcaccatgccccataggaatctgacaggaagctgcaacgttaattgtggttgtaaaatacacgagtatgagccagtctgtggatcagatggaattacatactttaacccttgtctggctggctgtgttaatagtggtaatcttagcactgggatacggaattatacagaatgcacctgtgtccaaagtcgccaagtgatcactccacccaccgtgggacagcgaagtcagctccgtgtggttattgtcaagacttatctcaatgagaacggctatgctgtgtctgggaaatgtaaacggacctgcaatactcttatcccattcttagtttttcttttcatagtcaccttcatcacagcatgtgcccaaccatcagctatcatagtaacactcaggtccgtagaagatgaggagagaccttttgcactgggaatgcagtttgttttgttgcgaacacttgcatacattcctactccaatctactttggagcagtcattgacaccacctgcatgctctggcaacaggaatgtggtgtgcagggttcttgctgggagtacaacgtgacgtcgtttcgttttgtgtattttggtttggctgccggcctcaaattcgttgggtttatttttatttttctggcctggtactccataaaatacaaggaggatggactgcagaggcggaggcagagagaatttcccctgagcaccgtgagtgagagagtgggacaccccgacaatgcccggactagatcttgcccagctttcagcacccagggagaattccacgaagagactggcctgcaaaaagggatccagtgcgcagcacagacctacccggggcccttcccagaagcaataagttcctctgcggacccggggctggaagagagccccgctgccttggagccgccctcctgaagcttgaaaatggaagaatttagttttgttggttgaattgaaaatggcgacttgagaaacaactgtgccttcttttctttctttcttttttttaacctctacagacacaatcctcaaaccaacaaaactcagtatacacagccgctattcattgagggctggatacctcaacaagactgagagcctttccccgcttctctccaaga

SEQ ID NO: 6520 - DNA, 2546 bp, Homo sapiens
gcgcggggagcgcggggagcgcggggagcgcggggctgcgctcgtgtgcgctcctgggcgctcgccgccgccgctgccgccgcgcgcctttgagtcagcaaactccgcggcccgcaagcccggctcggcccggccctgctctgttctgcccggaggagccgcccattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaa

SEQ ID NO: 6521 - DNA, 2491 bp, Homo sapiens
atagttgaccagcttctgcaggggctcctcagtgagagaatggaggtgaggtcagggactcctgccttgcctctgccatcacttccagtgatgcctattcctaagattgatcgtgtcctgtgctgaagatgtttccggaacaacagaaagaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagtggggcagtgttaccataaacacggtgtatatgttgttaaaccctatgaagagtaacagtgtagaccagactgcctctctcagatatgtgcctgatattttgtggatacctcccctgcactggcaaaacactatgcttttgggtgttagactgaaatattttaagagtatttaacctttccagtattctgtttcacgcttagatggaaatgtatcttatgaatagagacatattaaaataatgtttacatcttagaaaaaacatagatagtgctagtaatattacttataactgtaatatatagattcagaaatacattttcattatccaaaatcagcttcaacaaatggtttctggagacaaataatttgttttcattatcattgtataatcaggttaatgatttattttttgactaaatgtgcaatttcttatcactagataactttcagtatcagtggtggttacttattacttaaatcagaggaaggattttataaagattaataaatttaattttaccaataaatattcccataatttagaaaaggatgtcgacttgctaatttcagaaataattattcatttttaaaaagccccttttaaagcatctacttgaagattggtataattttcataaaatgtctttttttttagtgtcccaaagatatcttagataaactattttgaagttcagatttcagatgaggcaacattttcttgagataattacccaagtttcatccatgttgaatggtacaaaatatttctgtgaaactaacaggaagatattttcagataactaggataacttgttgctttgttacccagcctaattgaagagtggcagaggctactacaaaaagcaaccttttcattttcactaagagtttaaaagctattgtattattaaaaagtctttacaatgcttgtttcaaagaaccaacagaaaaaaaagctaagaaaactgagaactaacattaaaaaaattaaatttagaataagaatgatttctttaatttgtcctttttttctttggtctaaaacattattaaatttttgtaaatattttgatttaatgtgtcttagatcctcattattttaatacaggaaaagaaaagatttagtaatttcttaccatgctaatatgtaaagttcatgccatccaggcatttaagagcgatcctcatcccttcagcaatatgtatttgagttcacactatttctgttttacagcagttttgaaaaacacatactatgccaccaattgtcatattatttttagatgatgtaacatagccatcaaaattaatattatgtaatgcctaatacttagtatgtaaatgtcacgagatcatttttacattaaacgtgaaaaaaaatcaa

SEQ ID NO: 6522 - DNA, 880 bp, Homo sapiens
gttctgcccggaggagccgcccattgatcgtgtcctgtgctgaagatgtttccggaacaacagaaagaggcatttatttattcattaaatgatactaatggaaggcattggatgtatgaggcattcaagtcttacaagacagcctaagctgccctacaggagcttagcgtctgctagaggaggcctacaggaatttgtaagtgtctgggttcgagatcctaggattcagaaggaggacttctggcattcttacattgactatgagatatgtattcatactaatagcatgtgttttacaatgaaaacatcctgtgtacgaagaagatatagagaattcgtgtggctgaggcagagactccaaagtaatgcgttgctggtacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgtta

SEQ ID NO: 6523 - DNA, 944 bp, Homo sapiens
actgcttatttccatcatcctggctgtcttcagggctgttatgttcctgggttatgtgcaagatttcagagtactggcataaatataaatatatgtttggtggtttaaatcctatttagagtgaatgttgagatcatattgtgaattatagatacaagaaatgcatttttttcctcagacaactgccagaacttccatctaaaaacctgtttttcaacatgaacaatcgccagcacgtggatcagcgtcgccagggtctggaagatttcctcagaaaagtcctacagaatgcacttttgctttcagatagcagccttcacctcttcttacagagccatctgaattcagaagacattgaggcgtgtgtttctgggcagactaagtactctgtggaagaagcaattcacaagtttgccttaatgaatagacgtttccctgaagaagatgaagaaggaaaaaaagaaaatgatatagattatgattcagaaagttcatcctctgggcttggacacagtagtgatgacagcagttcacatggatgtaaagtaaatacagctccgcaggaatcctgaaaaataattctaatgttactatcttaggaatagcaaattatgtccagtcatagagaagaaagcttcataataatacattcttacctaaagctcactgtcatgatgttaggtatttaaattcttaaagatgttgggttgtttattagtggtatttttatgttgtcttattttaggtaagcttctgtgtaaagctaaaaatcctgtgaatacaatactatcctttacaggcagacattattggtaaacaagatcttgccctccaatgaaatgacttacatgttttaaaaaaccgagttggttttattgaatttaaaaagataggtaactaagtagcatttaaaatcaagatagagcattccttcttgtatcagt

SEQ ID NO: 6524 - DNA, 3486 bp, Homo sapiens
ggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataat

SEQ ID NO: 6525 - DNA, 3348 bp, Homo sapiens
ccgcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaa

SEQ ID NO: 6526 - DNA, 3111 bp, Homo sapiens
gcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacaggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaa

SEQ ID NO: 6527 - DNA, 3340 bp, Homo sapiens
gcggccgcgcacgcgcggcggggggcgtggggctgggcccagccggacgcgacctcagcctgcggcggctaactgccggtaggcgtctgtgtgcgccgccaagtcggtggggcggggacgcgaggtgtggatggggggtcgccttgacctctgcctcagccagtagcgcagtctcggcctcgccgttacggagatggtgccctgggtgcggacgatggggcagaagctgaagcagcggctgcgactggacgtgggacgcgagatctgccgccagtacccgctgttctgcttcctgctgctctgtctcagcgccgcctccctgcttcttaacaggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtgattgagtctcatagtctttcatttgctagctgtgatccaaattttattagaacataagtcacttgttattgccatttttaaaagagaaaattcataatgatgttatggcaaacagataagactgataaacttcgtattgtatagctttgaaaataattatgcctagtatggagaaacaggaataagatctgattttcttagagttaatatattttagtagattggttttccttttttttattttgtacatagttaactgtgtatctataaataaagcatcctatatgagtttttaataataaa

SEQ ID NO: 6528 - DNA, 3193 bp, Homo sapiens
gtgctgtagtttcttccgggctccctacaaccttcttccctctcctccgcaatacaggcagttactgggtgctggggctgtcctttgatttccggaaatggccggtcgccagtgttgtcagagtttccacggaagactgcgcgctactccggccaggagggcggagcggcgagacgctagaggctttgcgctgggtgacgacttcgggcacgttctacggccgttcctctggtcggctggggaccgcggccgcgcacgcgcggcggggggcgtggggctgggcccagccggacgcgacctcagcctgcggcggctaactgccggtatattcatattttaatgatcttctggtcatttgttgctggagttgtcacattctactgctcactaggacctgattctctcttaccaaatatattcttcacaataaaatacaaacccaagcagttaggacttcaggaattatttcctcaaggtcatagctgtgctgtttgtggtaaagtgaaatgtaaacgacataggccttctttgctacttgaaaactaccagccatggctagacctgaaaatttcttccaaggttgatgcatctctctcagaggttcttgaattagtgttggaaaactttgtttatccgtggtacagggatgtgacagatgatgaatcctttgttgatgaactgagaataacattacgtttttttgcatctgtcttaataagaaggattcacaaggtggatattccatctattataaccaagaaactattaaaagcagcaatgaagcatatagaagtgatagttaaagccagacagaaagtaaaaaatacagagtttttacagcaagctgctttagaagaatatggtccagagcttcatgttgctttgagaagtcgaagagatgaattgcactatttaaggaaacttactgaactgctttttccttatattttgcctcctaaagcaacagactgcagatctctgaccttacttataagagagattctgtctggctctgtgttccttccttctttggatttcctagctgatccagatactgtgaatcatttgcttatcatcttcatagatgacagtccacctgaaaaagcaactgaaccggcttctcctttggttccattcttgcagaaatttgcagaacctagaaataaaaagccatctgtgctgaagttagaattgaagcaaatcagagagcaacaagatcttttatttcgttttatgaactttctgaaacaagaaggcgcagtgcacgtgttgcagttttgtttgactgtggaggaatttaatgatagaattttacgaccagaattatcaaatgatgaaatgctgtctcttcatgaagaattgcagaagatttataaaacatactgtttggatgaaagtattgacaaaattagatttgatcccttcattgtagaagagattcaaagaattgctgaaggcccatacatagatgttgtgaaacttcaaactatgagatgtctttttgaagcatatgaacatgttctttcccttttggagaatgtatttactcctatgttctgccatagtgatgagtatttcagacaacttttaagaggtgcagaatcaccaacacgcaattcaaaattgaacagaggtagcctaagtttggatgattttcggaacacacagaaaaggggagaatcatttggaatcagcagaataggtagcaaaattaaaggagtattcaaaagtaccacaatggagggagctatgttgcctaattatggtgtagctgaaggtgaagatgattttattgaagaaggtattgttgtaatggaagatgattctccagtggaggctgtgagcacacctaatactccccgaaaccttgctgcatggaaaattagcattccatatgtagacttttttgaggatccctcctctgaaaggaaggagaaaaaagaaagaattcctgtgttttgtattgatgttgaaagaaatgatagaagagcagttggacacgagcctgaacattggtctgtctatagaagatatcttgaattctatgtacttgaatcaaaactaacagaatttcatggtgcatttcctgatgcccagcttccttctaagaggatcattggccccaaaaattatgaattcttaaagtcaaagagggaagagttccaagaatatctacagaaacttctgcagcatccagaactgagtaatagtcaacttctggcagactttctttcccctaatggtggggaaacacaatttcttgataagatactaccagatgtaaatcttgggaaaattataaaatctgttcctggaaaactaatgaaagagaaaggtcagcatttggaaccttttatcatgaatttcattaattcttgtgagtctccaaagcctaaaccaagtagaccagaactgaccattctcagccctacttcagaaaacaacaagaagcttttcaatgatctgtttaaaaataatgcaaaccgtgctgaaaatacagagagaaagcaaaatcagaattattttatggaggtgatgactgtagaaggagtctatgattacctgatgtatgtaggacgggtagttttccaggttcctgactggcttcatcatctcttaatgggaactcgaatcctctttaaaaacaccctggaaatgtatactgattactatcttcagtgtaaactagaacagctatttcaggagcaccgtttggtctcactcataacacttctcagagatgctatattctgtgaaaacactgaacctcgctctctccaagataagcaaaaaggagcaaaacagacttttgaagaaatgatgaattacattccagatctgttagtcaagtgtattggtgaagaaaccaagtatgaaagcatcagacttctgtttgatggcttacagcaaccagtactcaacaagcagctgacttatgttttattggacattgtgatacaggaactgtttccagagctcaataaggtacaaaaggaagttacctctgtgacatcttggatgtaaacacttggatttggtatagaataacccattgaaatttctgctgtgcgagggtggtagaaatttacttttttgggtatattcttatatatattatgtacatcgctgtctgaaattttagttattttttgtttttaataaagactaacacaaacttaatgattaaaagtga

SEQ ID NO: 6529 - DNA, 1853 bp, Homo sapiens
acacagcagggatcttgggcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagggggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaa

SEQ ID NO: 6530 - DNA, 3032 bp, Homo sapiens
ctgcggttaaggagagtccggtttaaccgtcaccgggaagcgcgctcgttcgggatcgccgagggggctgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactttaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctgtcaaagtgcacaggtatgttctcagaacatttttcacaatgtgtatcagaaatatgtttgctatccttagagacagaaatgaatataataaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcactacaaca

SEQ ID NO: 6531 - DNA, 3452 bp, Homo sapiens
gcccgggcagagactggctgaggcggggagcagctgcttttggggcgggggtgtcacgtgaggcttctcgctgctgagggaggaggcgaaaagctgcggttaaggagagtccggtttaaccgtcaccgggaagcgcgctcgttcgggatcgccgagggggctgagtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactgccttgcagtgagagaatttctttgtttggatgatccaccgggtccatttgatagcctagaagaaagcagggcattctgtgaaactttagaagagacaaactaccgcttacagaaagaactacttgaaaaacaaaaggagatggaatcactaaagaaactgctcagtgagaagcaacttcatatagacactttagagaacagaatcagaacattgtctttagaacctgaagaatcactggatgtgtcagaaacagaaggtgaacagatcctaaaggtggagtcctctgcacttgaggttgatcaagatgtcctggatgaagaatctagagctgataataaaccatgcttaagttttagtgaacctgaaaatgctgtatcagagatagaagtagcagaagtggcatatgatgctgaagaagactaatgtatcacaagcagttccctccatttagactattcaaaaatttagaagagtggcaaatactattttaaaagaagaaccaagaactgtaaaacatatagaaaagagcaagaatgcacatgtataaagtttacataaagaagtttttttaagttattgagataggaaatatattcactgctgcttttaattgtattttatccaattacatttaatacactaaaaaaaatcttgttggaattctgttatcaaggcccacattcttaaatactgtgcataaattattatggtgttttgcctatatattgctccaaactactgtgtatatatgtatgtgtgttaaatcaccaattatattaatcaaatggaaattaattgcatgttactatctgggtgatatattcttctttatatctctgacatgacatattttcattaatagtttaaatcagtgaccatcataataaagataaaatttagttgagtttttaatgtttacatgtttacatctctaaataaaatttgcttatttgaaatgttaatgctctttagaaaaatgactttctagtaccaaaggaaaactacttgaaagagctgtaatcatatagctaaagtgataagatagccttgattttaaaagctgattcattaatatcaaaatactttaataagtgtcacagttattaatatgttacatttgtttagtttccacgtaatctttatctctacctagatttagtgagtttgcctctttcagaatactacctccttttgttaaggcatattctttcgaaaatatagattctaaataaataggggcttatacaaaaaagaaaataaaaagccatatatactgcaaagttcctaactggcttgactcctgacattgcatttttatttctatttgtgtgaagatgttgttatactgtattatggctgattttctttttaatatatttagccaagtgatgcactttatgataattaaactcttttgtgccaagtttaattggtggatttttttagtaagtagagttaggagaaagaattatgtagtgcctttactatttcactttctacaaaagtctcctagggtctttgagtcagctttatgaaaaaatgtttgtttatttcagctttgtgtacagtcattaaaagtgccttgtttcatttttataggatgaagttatttattttctattttcactgttttgcatattgctgttaataagcattgtaatcatgctggcattttgcaatcccagtcggtatgctttctaaaaactgagggaaacttactggggaaatagaataacaatctccatttttttctttactatctaaaagtttatcggtatcttgatgtatatatatattaaggtgtggctgtttaaaattctaatgacatatatcaacacattcaatggctgttgttaacctttgaagtaaaaaggagatcactttttaccaaataaccaaaaatttttagtctgtcaaagtgcacaggtatgttctcagaacatttttcacaatgtgtatcagaaatatgtttgctatccttagagacagaaatgaatataataaattgatctgcttatttattaaaattattattctagacttacaaaaggcttaaaaagaacaatcatttaatcagtaccattctgtatcttatataacagatctttgccaaattctagatattatagtgttgcctgtctgttctaaagcgaaccagccactttttcaatctggctttttggaagattgtatttaaagttcttcaaggatgaagaaaaaaatctgttaattaggtaaaccactattatttatatttataatttacttttttttacttttataatgcattttactcccagtattatgttcatttaataaattattttttcact

SEQ ID NO: 6532 - DNA, 691 bp, Homo sapiens
gctgctgagggaggaggcgaaaagctgcggttaaggagagtccggtttaaccgtcaccgggaagcgcgctcgttcgggatcgccgagggggctgagtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattg

SEQ ID NO: 6533 - DNA, 880 bp, Homo sapiens
gtgcgtctgggaggcgctgggcgcgcaccggtcagcggaggcgggagagtctgtgatcccagggagctgcgggtctcgccgcctgcagtgcggaagacccgtgaccggcgcagaccccggccttaccttccgagggtcgaactgtgcctggtatttgcctctttcctcccgcccacggggttgctcagagtcgggccacctcacctgaggttttccagagtgagaatgaactgagcgtcctgggagcaactccgcatcaggtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagaca

SEQ ID NO: 6534 - DNA, 577 bp, Homo sapiens
caaccttgatgtctggcgggcggcaaggggctccgcgggagagtggagaggcgccgcaggaagcccagccaccttcaggccaccgccgaccccactgtgcgtctgggaggcgctgggcgcgcaccgtactgtcaagatgataagcatggaataaagcttcagaagggtctttaccaatctttctcctaccaacttttacatacatgaaatcaggttaaaatgaactttacagaaatacttcacaagggaataaagtagaggaaaaagggataacatgtaacatggagtcaaggaaaaagagtgtgaagtagttttgctctctctatcttgcaaataggagtccttaaagacaactgggagaaggggtttgagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagct

SEQ ID NO: 6535 - DNA, 804 bp, Homo sapiens
gatgactacaagtcccatgatgcaaagtatgagcacggaccaatgttggtcgcagttccttctgggaattgtagtcttctcctgtttggcaaactagatagtgaattcctaagaagaaaataatggattgcatattagttgttctctaagtggactcaacagtgtgcaagcttgttggaaaagccaaaagaagatggcaactccttatgtcccagttcctatgcccataggaaactctgcttccagttttacaacaaacagaaatcaaagaagttcttcttttggcagtgtctcaacaagctcaaattcttctaagggccagttagaagactcaaatatgggtaattttaaacagacaagtgttcctgatcaaatggataatacttcatctgtctgtagcagtcccctcattaggactaaatttacaggtacagcttcttccattgagtattctactagaccaagagacactgaagaacaaaatccggaaacagtgaattgggaagatagaccatctacacctactatactgggttatgaagtgatggaagaaagagctaaatttactgtatataaaatactagtaaagaaaaccccagaagaaagctgggtagttttcagaagatacactgacttctctaggcttaatgacaaattaaaagagatgtttccaggttttcgactagcacttcctccaaaacgctggtttaaagataattacaatgctgactttttagaagacagacaattaggattacaagcgtttcttcaaaatttagtagctcacaaggacattgctaactg

SEQ ID NO: 6536 - DNA, 3241 bp, Homo sapiens
ggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgtaagttggattgctcgacaggcagcttcctcctcgagtatcttgcattagggaatgagtactctttctcgaaggttcaaagagtacctttgatgacagtgctatcattttagagtttgaatagttgagtaatgagctgctcaaatctgtaatcttgagacgagggtagaattagaaggggacctaaaccatgttaggtatctgtttgaacactgcactgtcacttagtggtgagtttcaaaaagtgaggaaataatggagaagaacggatgtctgtaaatagaaatctgctttcacccttccacacctctcaatctctgctttggtagaggaattaagatcaattctctgagtttaagaaattcctgcaaagaattcttgcctgcaacctttacgaagtgaagtaatttcaggaaaagcgtactcattttgagtttgaaatctattaatgtactgaaattgagaacgttgtttaggaaaattgtttagggaaactacatagaatgaatataatctgagtattggatctgagagcagcgttgctggtatcccagtgagttagctgtccaactatcagagttcatgagttattaatagttgttagtgtctctgacctttgctaaagcaccagaatttgcaaattaaaaaaatatatagcagtagtgcttgtcttaacatttcttactaatgtgcattctcatataatgccttgattgagagaatggggaggtgtgggagttagggaggcagtcttgcctgtgaaagtccagtgtaggggcggctgggcagggaaacctactcctgagcagggaaacctactgtccctgtttcctcagcgggtctggcctttactggtgaagtgctcactgcctttctggtgggccagtccgtttatgagcaaccctgatctctggcatgtcttttcttgtattgaactgaagtttgcctcccttgattgtctttctgttccctgggaccgccttcagacatttggagacagcagtctcgcttccttcctctctgcttctctccttccccttccaaatgcgtgactggtcttctgactcctatgggggaaggggcttgctgggagaatgatcaaacgttttcagtcttgttgctgccgctgaaagggagtaccctggacatcagtactaattttagtagacagtagtaactttcttggcaatttgcgatttgtaaatgcagtctaatattgaattcgttttttgtgcaatcatattgctgttggcctgtattaaacctgtatttacatt

SEQ ID NO: 6537 - DNA, 5375 bp, Homo sapiens
agtcggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggtaaagcctggcccttagagcaggtgatatggagtgtattgtgcaggctgaaaggggcgactttgacagcagtaccactgtgggtttcagaatcatattctacaggtgaggaagcgagcagagacgtggacgcctgggtcttttccctagagtgagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttctt

SEQ ID NO: 6538 - DNA, 5218 bp, Homo sapiens
ggcgctgcgaagtggaggcgctgcgagcggagccgcgcggagggcgcgaccggctggtccgggcagcgtgggtttgccgccttcggggctccagtccgcgcgccagggctcgagcagtaccgcgggcccctcaggtgggcctcggctcgggacgccgggagtcgggaccgccagtcggggcgccgggaccatggcgctgcgcgcccgggcgctgtacgacttcaggtcggagaacccaggagagatctcgctgcgagagcacgaggtgctgagcctgtgcagcgagcaggacatcgagggctggctcgagggggtcaacagccgcggcgaccgcggcctcttcccggcctcctatgtgcaggtgatccgcgcccccgagcctggcccggcgggagacggcggcccgggcgccccggcccgctacgccaatgtgccccccgggggcttcgagcccctgcctgtcgcgccccccgcctccttcaagccgccgcctgacgccttccaggcgctgctgcagccacagcaggcgccgcctccgagcaccttccagccgcccggcgcgggcttcccgtacggcgggggcgccctgcagccgtcgcctcagcagctctacggcggctaccaggccagccaaggcagcgatgatgactgggacgacgagtgggacgacagctccacggtggcggacgagccgggcgctctgggcagcggagcatacccggacctcgacggctcgtcttcggcgggtgtgggcgcagccggccgctaccgcctgtccacgcgctccgacctgtccctgggttcccgcggcggctcggtccccccgcagcaccacccgtcggggcccaagagctcggccaccgtgagccgcaacctcaatcgcttctccaccttcgtcaagtccggcggggaggccttcgtgctgggggaggcgtcaggcttcgtgaaggacggggacaagctgtgcgtggtgctggggccctatggccccgagtggcaggagaacccctacccgttccagtgcaccatcgacgaccccaccaagcagaccaagttcaagggcatgaagagctacatctcctacaagctggtgcccacgcacacgcaggtgccggtgcatcggcgctacaagcacttcgactggctgtacgcgcgcctggcggagaagttcccggtcatctccgtgccccacctgcccgagaagcaggccaccggccgcttcgaggaggacttcatctctaagcgcaggaagggcctgatctggtggatgaaccacatggccagccacccagtgctggcgcagtgcgacgtcttccagcacttcctgacgtgccccagcagcaccgacgagaaagcctggaagcagggcaagaggaaggccgagaaggacgagatggtgggcgccaacttcttcctgacccttagcacgccccccgccgctgcccttgacctgcaggaggtggagagcaagatcgacggcttcaagtgcttcaccaagaagatggacgacagcgcgctgcagctcaaccacacggccaacgagttcgcgcgcaagcaggtgaccggcttcaaaaaggagtatcagaaggtgggccagtccttccgcggcctcagccaggcctttgagctggaccagcaggccttctcggtgggcctgaaccaggctatcgccttcaccggagatgcctatgacgccattggcgagctcttcgcggagcagcccaggcaggacctggatcccgtcatggacctattagcgctgtatcaggggcatctggctaacttcccggacatcatccacgttcagaaaggagctcttaccaaagtcaaggagagtaggcgacacgtggaggaagggaagatggaggtgcagaaggctgacggcattcaggatcgctgtaacactatttcttttgccactttggctgaaattcaccacttccatcaaattcgagtgagagactttaaatcacagatgcagcatttcttacaacaacaaataatatttttccaaaaagttacccagaagttggaagaagctcttcacaaatatgatagtgtttaatgactggacgttggattatggactttttcagttcaaggataatttctacagcagaataaaaactgctgtcaaagagctattgccagctatcagtggtggtacaaggacggttttgtgttcatctgaaacccagctgaatttataattatgtaggaaataaacagttaatatggttatataatagaaacagtaccacacattgtaactaaattatactatgtatgcctacactaccattgtaacttttggaataatgattatactatttgccttattgctttttgaagtatgggtattttagtgcatactttgtagacctcaaaacccatgaagggtctcaaagaagctggctggatacaagcctgctgtggatgcctttttactctcatagattgggattacctaaattcaacctattctctgtttacaaactccaactagagcagctatgcgaccttgtgcctttagactcttggtttttcatttctccccgtcccttccccacctttttaaagtaagccacagcttttctgattgaaagagtgaaaggccagtgcatataatgacaaactgatgataaccttatattggcagtagggggtggggggggcggtggggtgggacgatcagctgtcatcaatttgcacagcaagtattatctcctgataagatgctggtgaatgcaggggagtgagattcattgctcatctttggatatgaagtctgttagggaagaaacagtgccactattcccttagatgcaacagtagcatagcctcttcacccaggcgtcccaaaagcttggcgtgaagatttcagcaaacatgtcttacaacatgaggaggaggagtctaaatcagtcaggggataaaagtatcgaatcattgacaacacacacttggctttagttcttaggagggttttgtttttgtttttgtttttaggttgaagattttcttttaatattcagttttttgaaaaaaaatggatctacactgttaactgattgagactccactgtgattcacttgtttacttaaaaacttttcagggatgtctgtaaatttcagtgttaatatgtcatgaaaagtggtgtggattgatctaaggagggaccagaaataatttttgctattccaaatactgaaggaaaaagataattgatttatactatgttttaaaaaaaaaaaaggtattgatgagccccccccccccaggacatttaaccttaaaatttattttaaatgtattcttttattattataagggaaatacagatggctgataaataccaaaaagattcaaaagcagcttaatttaaaaagcacaaagagattctggcttacagtgccccaatctcaatgtttttatagttgctgagctaactaatgtgattattgagtttacagatttaaaaattgtcactgttagagtatctactgtttttatgaagtcaaacttatgctgcctcagaaatccctgggtactgaaatggtaacatggaagtgaagaggtcactttgaaatattggtgagtcacaaagattaaagaaaaggatcagtttgcagatactcagaaaaggttattgaaataattactgaacagcacattttctctctaaaaagtagtttcatatgggttgtatttttaagatcagattatcattttgatatttggtcaaaattttgtaccttaggttacttagagccagatttaacatcatgaacattatgtggctttgtctttactacagatatgtggaactgtaaccaaatatgttgtctctaaaacttgttgattgcaaaatacagttctataaacaaaacccatatgtatatataaatgttaattttgcggaagtctggaaattataactatagcatttaagtttgagtctgtattggacaaataagcaccatgcttttcaaatgatttaaaaattacttttatttgcctctttattttgatggtggttggatttttttttttttaatagtaaaatcactaaacttgtgcaatggtagcatggaaattatctgaggtatattgtatgattgtactttagccagggtggacatagcttaaattataaaaactaaagatgaaagtacaaggaagtataagttatacttatgtaagtataaattcatgctgcctacttctaagagaaatttcattcttcataaccacataacattataatgccactgattcatacgggatttacattaattctatgggggaggacactagaattattagtgttcattttcatctaagatctttattctctaacgttcttggtcctattgaaacattgcagtatgcaaaactactgcaatgttaaacccaagagaaaagccattatcatgtgtatgctggtcatcatgatcagtgtggtacaatttttaaaaataaactatcatgcccttcatgccattatttgtctttatttctatgatttataatcctgatatgtgatgtgtttgtaacacagggtgtgcacttgagcctggttttactgtttttattagacagagttgtttatatgctgtaactgtaacgcagcgagactggttctacagccatgtgtcgtaatcttgttccccgtccaagctgttgtatctgaaggtacccagtttgcacccaggatgagggaacgcattcaaaagtgaaatgtaaagccagtgcacgaatattatagtaattgagattttcccaggcttcactgatacagttgttttgcatttattcacaataatacagcagattcttaaatgccgatttttaattgtcttaaattttgctgctgttctcataattaaggacttgaaaaatgttttagtctgtcaagtatgtaaagtttgtgtaaaaacttttaaatgtcattcttaagttcattgccatagccattttccatttatgtcttcattttccaaaaatcaaatgccatgtctgatacctttaagtccataagcattcaattttctcatttccaccttcatctttggttaacagaataagtaaaacagggtattatttatttgtagtctagaaatgttgaatattgttttatttccttcaaaatgttatgattagtgcagatcagccatgtttatctttttaaaaaataaacaggttgctttatttctt

SEQ ID NO: 6539 - DNA, 6535 bp, Homo sapiens
atgcctcgctcccgtcgacgtcgacccggaagctgtcgccggcggccggccggcggtcagccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgtaagtgtccgtgggccccagggccttgcagcgcccgccccgaggccccgaagaggccttccgcctggggcagtgtgaaggccacagagttttcctccaaagccacacctcagctggaaggggcgagttggagggctctgttagtggtagccatggggagacgcggagctgcagctgtcgctttgcagtgcctgtaggactttgagggcctggagccccggttccctgaacagcacccagatcgccccatatctgagacacagttcatgccccccttccctaactctgaagtaaaatcttgagggctgtcatctggggaagccaccttgtccgttcagccatgaagacagaaacagtgccaccgttccaggaaactccagctggatcgagctgtcacctcaataacctgttgagtagccggaagctgatggctgtgggggtcttgcttggctggctcctggtcatacaccttctggtcaacgtgtggctgctgtgccttctgtcggcattgctagtggtgctgggaggatggctgggctccagcctcgctggagtggcttcaggtcgactgcatctggaacgcttcatcccgttggccacctgtcctccatgccctgaggcagaaaggcagctggaacgggagatcaaccgcaccatccagatgattattcgagattttgtgttatcttggtaccgttccgtgagccaggagccagcctttgaggaagaaatggaggcagccatgaaagggttggtccaggagcttcggagaaggatgagcgtgatggacagtcatgctgttgcccagagtgttctgactctctgcggttgtcacctgcagagctacattcaggcaaaggaggccactgcagggaagaatggtccagttgagccttcccacctctgggaggcttactgccgggcgactgccccacatcctgctgtgcacagccccagtgctgaagtcacctatacgcgtggcgttgtgaatttgttgcttcaagggctggtgcccaagccccacttggagactcgtaccggacgccatgtagtggtcgaactcatcacatgcaatgtaatcttaccactgatcagcaggctgtcagatcctgactggatccaccttgtactcgtgggtatcttttccaaggccagagatccagcaccctgcccagccagtgcccccgaacagccctcagtgccgacatctctgccactgattgctgaggtagagcagcttccagaagggagagcttctccagtagcagccccagtattcctaagttacagtgagccagagggttctgcaggcccctctccagaggttgaagaaggccacgaagctgtagagggagatttgggtgggatgtgtgaagaaagaaaagtaggaaacaactcatctcatttcctacagccaaatgttcgaggtcccctgttcttatgtgaagactcagagctggagtctccgctgtctgaactgggcaaagaaaccatcatgctcatgactccaggcagctttctctctgacaggattcaggatgccctgtgtgccctagagagttcccaggctctggaacccaaagatggtgaggcatctgaaggagcagaggctgaggagggtccagggacagaaacagagacaggcctgccggtctccacactgaattcctgcccagagatccatattgacacagcagacaaggagatagaacaaggagatgttaccgcctctgttacagctttgctggaggggccagaaaagacctgcccctcacggccgtcatgcttagagaaggatctcaccaatgatgtgagctcccttgatcctactctgccaccagttctgctttcctcctctccacctggtcctctcagctcagccaccttcagctttgagcccctaagcagtcccgatggtccagttatcatccagaaccttcgtatcactggcaccattacagcccgagagcacagtggcactggattccacccatacacactctatactgtgaagtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaacaggaaaaaaactgtggccagatttccttggaggagaaaacaaccttctcagctctctgttcctacccggaaactaaaaattcattcagggccattctcaaaaaccagactcctgggtctaatctagtttcccaacagttccagaagaagaaggagggaagaaaatttttcaaggaacttcttgctcatgtgttgctgtttcccaacacatcagccttatggaagatgtcatgaggctgcttgcctgggaggctacactttcctttccagaagacttcaaagctgactgccaaagcttctggtaaatccaccccacccttcacaccctttcctgaaaggcatttataccacccattttatttattggctttgctcccaaccccctgccctagagcaattgagtttttgaatttttgaccctctctctgtcttcagcaaaactgcatgacaagctgcatattcagcctcagtttttccaaggagaatggaaagcacttgcctcctgtcttaagaatgcacaaagagtaggactagcaaggctgggggatgaaatctcccttcctaagtctttgacagagaacttttattattctgaacagataagattagcaaacttacaaggaatagcttcttatttcccattccttacggttataatcagtcctttaacaacaccagcatgaaggcaaaggtgttttgtcagactgcaacatctattagaaaggcaaggcaactgggaattgctggagaaggataaatcaggaggaattgctggtagaaaaggctgcagacagtcacagggaagtgctgtatattaaatgcatgtgaatagctggcaaaaagatgtcaaggatgtcactgggagccctttggcttcacactcgcctgttagcgccttgctttcgctgaattaccagagcctaccactcggaggaaggtcttggagttagactgatgagaaggcaatggggtgtcaaaaacaagtgtcaaagttctcttagattctgaagtcggtgatgagcacacaattaaagtggtttgtggaagaaagttgtaaaatctttttacttttttgcccctctggaggcttttaaccctaaattgtgtctgatgtattcgggaggcttaggtgtgcaattcttgcccaaaggcaaggagatgaatgagatgtctcatggcctcttctagccttaaaagttgaccattacagtgactttatggctccaaagttcttgaagcatctccagccctagactttgacaagaaaaggtagctcagcatctctactttccgtgagtacctgcaggagtccagccaatgtattagagctgatcattaagctccttcagtgagggctaagatcctattctcgatgagcatagggggacagccttgttttatgccacttttctctccccatacctaccttcccctcatgtgtacttagccacctgtgttgctttgaatctgctgccagttctggctcaaatgtggcacaaaatcagtacatcagacacaccatgaaatccctgtggctataaattctaaggaatcttttgacacttccagcccaaagaacttatttttatttcgtattatataagagtccccacctctactccacgtaccccaaaaagataagctgtcctcagatcctccttctacccaggagggaaataatggatattgccaagggaacaatcagaactcatctggctttgaaaacgacctgccaagtttggctagcaggttcagacaacaagagagtaacaattggtagagagccacaggtagaaaagatactcccagctgacagggtgataaaaggcagggaagaattgggcctgtgctgatccaggaaggttttattgtttgcttgttttttgtatttactcgtgactaaattttattcatttaagtcagaattttgatatttgaaataagactactttcccttttcttactatctataaaaaagacgaggcagggatgctgtgttctttctgtcaaattctaaatgtgatctttgccattgcttatttgaattcaagaaagctatactttttcatcacatataactcacagtttcatttttgcattgttggattagacttaataaaacctaaatggaaaataaattcctaaatctgagcctaggagcatgtataaattttatttttattattattatacattaagttctagggaacatgtgcacaacatgcaggtttgttgcatatgtatacatgtgccgtgttggtgtgctgcacccgttaactcgtcatttacattaggtatatctcctgatgctatcccttccccctcccccgacctcacaacaggccccagtgtgtgatgttcaccttcctgtgtccaagtgttctcattgttcaattcccacctatgagtgagagcatgtataaattttaaaatcaatacaagctactccaatttccattttggaaatttccagtttacaaggtgattttcttattgttgtaaagaaacacataatgtgagatctaccctcttaagtgtacagtacattatttatttattttgagacggtacattattaactagaagcagcacag

SEQ ID NO: 6540 - DNA, 1562 bp, Homo sapiens
agccttcacacaggcccggctgcggagcgcagtcgcccaggtttacggcggcagagggccgaggctcccggagaggaccgcgatgagtccacttcaggtcggggctgagtgtgggcgcgcggttcccggcggcgtgtgacccagtcttcgccggccgctgcccgctgcgtgtgattcaggatgccctgtgtgccctagagagttcccaggctctggaacccaaagatgtacgagacagcccttgacggtgaaaacagcagcggcctgcagcagctggcctaccacactgtgaatcgtcgctatcgggagttcttgaatctgcagacccgtctggaggagaaaccagatctacgaaagttcatcaaaaatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaagatggtggtgagtgccattgtggacaccttgaagacagcgtttcctcgctctgaaccccagagccccacagaggagctgagtgaggccgagaccgaaagcaagccccagacagaaggcaagaaggctagcaagtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtca

SEQ ID NO: 6541 - DNA, 1430 bp, Homo sapiens
aagatgtgaagggtcctaaaaagctctttccagatcttccattgggaaacatggacagtgacagagtagaagcccgtaagagcctcctagaatcattcctaaagcaactctgtgccattccggagatcgctaacagtgaggaggtgcaggagttccttgctctgaacacagatgctcgtattgcctttgtcaagaaaccatttatggtctctagaatagacaaggtctaggctgaggttctcatccagtaaaatttctccagcactaagtgtgactgaagcacaagacaagattctttattgtctccaggaaggcaatgtggagtctgagactctatccatgtctgcgatggaatcttttattgaaaaacagacaaagttactggaaatgcagccaacaaaagccccagaaaaagatcctgaacaacctcccaaaggacgtgtggacagttgcgtgtcagatgcagccgtgccagcccaagaccccagcaacagcgatccaggaacagagacagagttagctgacacagccctggatctgctcctcttgctactaacagaacagtggaaatggctatgtaccgaaaacatgcaaaagtttcttcgtcttatctttgggaccctagttcaaaggtggctagaggtgcaggtagctaatttaacaagtccacagcgctgggtgcagtacctcctgcttcttcaggagtccatctggcctggtggagttttgcctaagtttccacggcccgtaaggacccaagagcagaaactggctgctgagaaacaggctttgcagagcctgatgggagtcctcccagatctcgtagtagaaattcttggggtgaacaaatgccggctgagctggggtctagtcctggagtcactacaacaacccctcatcaacaggcatttgatttactgccttggggacatcatcctggaattcttggatctcagtgcctctgttgaggagtctgctgctaccacctctgcctcagataccccaggcaactctaagaggatgggtgtctcctcttagctggttattcacgccttcttcccaggtcagggaagtagagttactcggccaccagagaccagtcaggaagcccgtgccctcttcaagtaggctacagctaagaaggcctaggttctcggtggctcacttctctcccacttctgctccatttgtagcaggtgacaggggtctgtgtgtcccagttgtatgcacgtttatttccctgttccttttgtgatgttgggattgttgctggtgagtagatcctgtttcctttgggaaaagaagctgtgaggtagaggaatgaaccccttttgcttctccttttgccatcctccctgagattgtttgccagaatcctggccctgtgcacacatgtgcttaatccaccagcacacaagctctagatagaa

SEQ ID NO: 6542 - DNA, 3614 bp, Homo sapiens
gctccgggagagttagggctccgagccgagcgcgcggagcagctggggccggggcgcggatgctggaagttcacatcccgtcggtggggcccgaggccgaggggcccaggcagagcccggagaaaagccacatggtgttccgagtggaggtgctgtgcagcgggcgcagacacacggtgccaaggcgctacagcgagttccacgcgctgcacaagcggatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagccgggcattgtggtggtgcatgcctgtaatcccagctactcgggaagctgaggtaggagaatctcttttttttttttttttttttttttgagacggagtttcactcttgttgcccaggctggaatgcaatggcacgatctcggctcacggcaacccccgcttcccgggttcaagcaattctcctgcctcagcctctcgagtagctgggattacaggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgtg

SEQ ID NO: 6543 - DNA, 3713 bp, Homo sapiens
ccgctccgggagagttagggctccgagccgagcgcgcggagcagctggggccggggcgcggatgctggaagttcacatcccgtcggtggggcccgaggccgaggggcccaggcagagcccggagaaaagccacatgatcaagaagctgtacaaagtgcccgacttcccctcgaaacgcctgcccaactggaggaccagagggttggaacagcgccggcagggcttggaggcttacatccagggcatcctgtacctgaaccaggaggtgcccaaggagttactggaattcctgagacttcggcacttccccacagaccccaaggctagcaactggggcaccctgagggagttcctgcctggcgacagcagctcccagcagcaccagcggcctgtcctgagcttccatgtggatccctatgtttgcaacccctccccaggtgaggaggtgcctagatatggggctacagggctgggttgtgggctttgcatttctcggctcctgggaccctcagacagcatctccttcctgctgcccacctctggagccactacctcctgctcctgtcccctggagcctgctttgtagacacaaggaaaacaagtttggcttccctggtctccatttcttcagcagcctgacttctttaccaagctgatgtgaaaagaatgtgacctgggaatgcggaggcttcatttggggtggacagctgctgtctgctgccttggcaggggctcctactcccaagtgggggctgagcccatgagcaggagctcaaggagctgcaggtctgaggccagacctgtttaattctatcccacagagtcgctgcccaacgtggtggtgaatggtgtgctccagggcctctacagcttcagcatcagcccagataaagcccagccaaaggcggcctgtcaccctgctcctctgccaccgatgccctgatcagtccagaggcctttggctgcctcctaagaaagtcatgtgcctctgtcctatgaactccatataaggctgggtcctcctttggcctggacccaggacttaattacccagtgcccagttgtgccacattcccactcaaggctcagaacttggctcgcattggtagctggaggtggtagaatttgtatgctcttagagcccaacagccaaggcagggtcaagaagataagtaataaaagaggaagtcagccaggcgcggtggctcatgcctgtaatcccagcactttgggaggccaagatgggtggatcacctgaagtcaggagttcgagaccagcctgaccaccatggagaaaccccgtctctactaaaaatacaaaattagctgggattacaggcatccgccaccatgcccggctaatttttgtatttttaatagagatgggtttcaccacgttggccaggctggtcttgtactcctgacgtcaggtgatccacccgcctcggcttcccaaagtgctgggattacgggcgtgagccaccgtgctcggcccaaggcaggagaatctcttgaagccaggaggcggaagttgtggtgagccgagatcgcgccactgcactccagcctgggcaacaagagtgaaactccgtctcaaaataaataaataataaaggaagaagtcagctgggtgcagaggctcatgcctgtaatcccaatactttaggaggccaaggcaggaggatgcttgggtctggaagtttgagaccagccagcgcaacatagtgagacctgtctctaccaaaaaaaaaaaaaaaaaaaaaaaatcaatttagaggtaggctatgaaaaagtacagatacatcccttaacatagactggagggtggtggcaaggggagcaaatgtggaggcccagtagctggcaaagtttagaagcagggggcaaaagctcctgcctgacttttcctgggtagctcctgggtcaaaatttcaggcaggatcccagggaaggggcaggcacccattgccacaggagagttgcaggcatgttgggatgtaggcctaggggaggtgctgcaggctcaagaaccaggcccacacattatatattaaaaaaaaaaaaacccacatttttttttattggtcagtgttggtaggagtttgttacaaaagtgagtccatgggcctgtggaatgtgaggggagtgggtccgctccaccagatgccagcaccggggccagtgcagctcagagccctgtggcggactacagggcctgcacagacggtcactcaaagaaagatgtccctgtgccctactccttggcgatggcaaagggcttctccacctcgatcttgccgcagtctgcgatgatcacatccttcaggggtttatcccggctgtctgtcttggtgctctccaccttccgcaccacctcctggaaaagaaaggtggaagcaggagggcatggtggatcaggaggtccaccgctcaggagaaaggccccagcgtatggctcaggagggctaagacccacaagtgatcaacagcacacaaaactggaggcaccaaaattctaacagactcctggccagagcagggagaatgcagatttgacgagggggtacaggaattttgttcctttgaagtaagacccaggttgggccaagggtgaggaggaggaagagggtgaccagggcatgtggcttctcagggacattgcgttcagctgcactctgtatacctcaggggtgggaccagcacgtcactgagtgaaggaggggagggaggctctggcagttgtgcagccttcctggctgggctctgagggggctggaagaatttagaaccttggaggcatggaggtacagggtttattctggacaggagcactgggctgcatctgtgggttgggtccttttgggaaagggatggacacatggagctcctgccctggggtctgtgttgaatccccggtgaggattgcccagtagtagcccttgcttccacaactcaccatgccctctagaactttgccaaacaccacatgcttgccatctagccaggctgtcttgactgtcgtgatgaagaactgggagccgttggtgtctttgcctgcgttggccatgctcacccagccaggcccgtagtgcttcagtttgaagttctcatcggggaagcgctcaccgtagatgctctttcctgggaaaaaagacagagcaggtcaggggcgctggattgcgccaaaccaagcagacattcggggccaggactgagggggcttaacctgtcctctgtgccaggctaggctggagtggactacaaggacataaaagcagcgtccttcctatcttctggcctcagagccaagccatgctgactgaggccaagtggggcatcaggccaggctgatgtggtgaacagctcacagaaggattactttgagaagatagttttgtggcttttaaataaggcgcatgttatcagctccccttagctatggcccaggcctgccacggagggactttggtggagggaagtgccgtgcaggatgcaggggagtcaacagggtcggaactctccagaaaaggaggactgctgtggctgaccagcctgttttcctatgagcacaaaagacacaggcatagctgcagaggagaaagcagccagagatgtgtggggaggggcagaaaagaggggctgccccttggattctggagagtcaaagcctcttaacaaggaatgaacaggaataaaagacagctgtgagtgtg

SEQ ID NO: 6544 - DNA, 2158 bp, Homo sapiens
ggcccccggcacgcccagggcgcgggagcggccgggtcagcccgcagacctgagtccggcccgcagcctcggggccccgcgggcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcgattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaagatgcttgccccgctagtggcagatgtgaactgacaaggagtgaagcgcccacccagcggatggacagcacccacctgggtttactcaagggtgtgcattcattttaggtgggatcgccacaggatttcatgttattttccttacggcttccttttcactgacctcatttgttgagttaatgtaagttaaatgtgtttatgatataactccactgtacatcatcctttgagtagtaaaggataaaagcatatatactacctatatgtatgtgctgtatgtgggcatttcattgagatctaattaatagctagcctatttatggttattcgttttagtaagttctgtgggagcaaggtatttaaaatcaaaactaataactacatcatggtttttgattaggatctaaatattcaggttttaagcctgctgcaaacttttaaaatattatgatagattctgtactacatgtgggaaacaagcaagaactaaataatcaaatgttgtcaaccaaaagtaatagttgggtattggagatttttttaaaatgtttttatgttattagctatttggagttaaataaaaacagaacaaggaaacatttga

SEQ ID NO: 6545 - DNA, 588 bp, Homo sapiens
gcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacaggtctaacagagtgacattggtcccgggcttaataatctgccaataaaccagtgctcttggta

SEQ ID NO: 6546 - DNA, 1563 bp, Homo sapiens
cggggccccgcgggcgcagcggggcgggaggcggggcggcccggccgtgggcggagcggcggccgcggccgtgagcctgcccccaactcgccctcagccggctggccggcgcggccatggaggtctacatcccgtcctttcgctatgaagagagcgacctggagcggggatacacggtgtttaagatagaagtgctaatgaatggaagaaaacattttgttgaaaagagatacagcgaatttcatgctttgcacaaaaagcttaagaaatgtataaaaactccagaaatcccttctaaacatgttaggaactgggtccccaaagtcttggaacagcgacgacaaggcttggaaacatacttacaggctgtcattttagaaaatgaagaacttcccaaactgtttcttgatttcctaaatgtgcgacacttgccctctctaccaaaggcagaaagttgtggatcttttgatgaaacagagtctgaagagtcaagcaaactgtcccaccagcctgtgctgctgttcctcagggatccatatgtcttgcctgcagccagcggtaatcaaacctgtcatctgctaacagctctttactgatctgaccctgcaccacataaaccacgtttttaatacagattttccaaatgtggttattgaaggagtcctccatgggatattttaccctcatctacagcccaggtagaaatcctacatggctaaaagaagcagaagcaagtttcgaagtcacagtcaaggaaatcaatacctaccaatttaacctaaacgctatgatatataacagctctagctagtggtaaagtgcacagtcccagcttaattcagggcagggacatttccattagaatggtgctcttaaaaatagaaactgaaccggggcggtggtcaggctaaggccaagtgtttaagaagtagagtgtagctgccagcgtagaaacccatgaaaaggaggccacaggagattcctgggagcactgggtgtagcaaaacaaagccactctctgcttcagtcgcaccatttgctaattgaaaatcatatcctgaatcatactgagactgatcaactttggtagcttttttgttcagatcttatgacacactactcttctcaccgtgagattttctcagccagtgatagtacattctgaaatgctggcaccaggagacggccacagacacacactgctaaatgtgaagatggaactaaactggaaattaaattatactgacaatattatggcatttttaagatcatggcattttaatttacattagagtggagttgcatcatactcaggggttagcttccaaggtcagtacataggtaaaatgggctattaggatgatccttgaaagccctttagaagggtgccatgttggaaacctgtacatccacaacaagtagcttttcctcctatgttggaaaaaaagactgtttctttgtttgaagaccaagtgaagttgttggtgtttgtttaggggccattttgttaaaaaaaaaaaaaaaaaagcacataacttttaacactagaatcagcccgcaaga

SEQ ID NO: 6547 - DNA, 1861 bp, Homo sapiens
atttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaagatgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatggaacttcaacaaatacgcttctgtctcctagagaccatgattgaaattttctgaaataaggcctgaactttggaatttgtaaaagatcctcgggtgattttaacatgcagagaagcttgggaaccactgctgtaatatcagagtcagccaagggactcagaagactcccccactcaggctgaacaatctgtgttccacaaacactgctctaccaagtctgctatgatgtaattctgactcgtggatgtgatggacctaagatgtgcacagctttttggtttttctttttttaaaaaaaatctaaacttaagagttagtactcataatgatctcccttacaccccctccactaccacaccccttgctttttagtatttactttgagatgtgaaacgcatttgggatctaaataaattgatcacatggatt

SEQ ID NO: 6548 - DNA, 3264 bp, Homo sapiens
gcggggctgagctccgtcctgttcaggctcagcctgtacctgagctgcgcggcggccgccttcctgctggggatcctgtttgccctcgtctgccggagcccgcgcgcccagccgcccgacttcgccgccgcctggagccggctggccgcgacctcagccgcccgccgcccgccggggagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacagcaactctgatgtggagttcttgaagcaactaaggtatcaaattgtagtggaaataatccaggcgactacaattagcagctttccccaactgaagaggcacaaaggtaaagaaactgcggcaatgaaagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaa

SEQ ID NO: 6549 - DNA, 3323 bp, Homo sapiens
ctgctcccggctgcctagggcggcgcgggtaggccccgttgttctcgtgcgttaatagggaaagctgccttgattatcttgtaattctctaccaaaccaagaataaaaaagaacggcggctgtgtgtttgtgatattttctatcagcaaatttcagttcataccactagttagttctgtggaccagaggctggtttcagaatggaaagacctttgccgagtggtaaacgagagtcctgtgtatggaaactcacatgagtcagctcagtctagaagggtagtaatttctcataatatggataaagctctgaaagaagtgttcgactacagttatagagattacattctgtcctggtatggaaacctcagcagagatgagggacaactttaccatctgctcttggaagacttttgggaaattgccagacagctgcaccacagactgagtcacgtggatgtggttaaagttgtctgcaatgatgttgtgaggactttactcactcatttctgtgacctgaaagctgccaatgccagacatgaagaacagccaagaccttttgtgttgcacgcatgcttgaggaactcagatgatgaagtaagatttctacaaacgtgttctcgggttctggtgttttgtctcctcccctcaaaggatgtgcagtctctcagcttacgtataatgcttgcagaaattctcacaacaaaagtcttgaagccggtagtggagttactgagtaatccagattacattaaccaaatgctgcttgcccagctggcgtacagagagcaaatgaatgagcatcacaagagagcctacacctatgccccctcttacgaggacttcatcaagctcattaacagcaactctgatgtggagttcttgaagcaactaaggtatcaaattgtagtggaaataatccaggcgactacaattagcagctttccccaactgaagaggcacaaaggtaaagaaactgcggcaatgaaagctgatctcctgagggccaggaacatgaagaggtacatcaaccaactgactgtggcaaagaagcagtgtgagaagagaatccgaatcctgggaggccctgcctatgaccagcaagaggatggggccctggatgagggggaagggcctcaaagccagaagattcttcagtttgaagatatcttggccaatacgttctaccgagagcactttggaatgtacatggaaaggatggacaaaagagctctgattagtttttgggaatctgtggaacatttaaagaatgctaacaagaatgaaattccacaattagttggtgaaatttatcagaatttctttgtggagagcaaagaaatatctgtggaaaaatcactttacaaagaaattcagcagtgtcttgtaggaaataaaggtattgaagtattctacaaaatccaggaagatgtttatgagaccctaaaggataggtattacccttcatttattgtcagtgacctgtatgagaaattgttgataaaagaggaagaaaaacatgcctcacagatgatttccaacaaggatgagatgggcccaagagatgaggctggtgaggaagccgtggatgatggtaccaatcagatcaatgaacaagccagttttgctgtaaacaaactgcgagaactaaatgagaaacttgaatataaaaggcaagctctaaattctattcaaaatgcaccaaaacctgacaagaagattgtttccaagttgaaggatgaaataatcctaatagagaaagaacgcacagaccttcagctgcacatggcaagaacggattggtggtgtgaaaaccttggcatgtggaaagcctccatcaccagtggagaggttacagaagagaatggtgagcaattgccatgttactttgtcatggtaagcctacaagaagttggaggagttgaaactaagaactggacggtccccagaaggctcagcgagtttcagaatttacaccggaaactcagtgagtgcgtcccttctttaaaaaaagtccagttgccttctcttagcaagctgcctttcaaatctatagatcaaaagtttatggaaaagtcgaagaatcaattaaataagtttttacagaatctgctttcagatgaaagactgtgtcagagtgaagcactttatgccttcttgagcccttctcctgactacctcaaggttatcgacgtgcaggggaaaaaaaattctttttcattatcctcatttttggaaagacttcctcgcgacttcttctcccaccaggaggaggagacagaggaggacagtgacctgtcagattatggtgatgatgtggatgggaggaaagacgccttggctgaaccatgtttcatgttgattggggagatttttgaacttcgaggaatgtttaaatgggtgagaagaacattaattgccctcgttcaggtcacttttggaagaaccatcaacaaacaaatccgggacacagtcagctggattttcagtgagcaaatgttggtttactacatcaatattttccgggatgctttttggccaaatgggaagttggcaccaccgaccacaatcagaagcaaagagcaaagtcaggaaacaaaacagagagcacagcaaaagctgcttgaaaacattccagatatgcttcagagccttgttggacagcaaaatgcccgccacggtataataaaaatattcaatgcactgcaagaaacaagagccaacaagcatctgttatatgcgctgatggaactgctgctaattgaactgtgtcctgagctgagagttcatttagatcaacttaaagctggccaagtttgagactacacaaataaaccaccagaaaaatgtctgtgtaataatagacatgaaacattttcctcttttccacagagggcttaactgagaaccgtattgatttttattttagttacctccctctagttttatgtgaaattagtagaatcagggaggacgggacttatgctgtggtaggcaacagaaaaaaacttctattgattttaatttaatatgaatactttaaagatcaacataccgattgaaatacaaatgttaatatgtgagaacctaggaagtattttaaatatttatgaaaatattttgttttaaaatgaactatgaatattgtacagttaatttcctcactgaggactgtgaacattcttatattatttcatgtatattgaagaacattgttatgcaatgctttgtgtaaagttattgtgaagattttattgtctttatttttaccaaagatttcccatagtttgagcattcaaagcaataaaatataaaaatgaatcaca

SEQ ID NO: 6550 - DNA, 1734 bp, Homo sapiens
actctcgggatggagggcgagcgccgggcatcgcaggcgccctcctcgggcctcccggccgggggcgccaacggggagagcccggggggcggcgccccctttccgggcagcagtggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatgaa

SEQ ID NO: 6551 - DNA, 1742 bp, Homo sapiens
gggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagtggctcttccgccctgctgcaggcggaggtgctggatctggacgaggacgaggacgacctggaggtgttcagcaagggaggttgaatgtcactccagtttctcaagttgctgctgagagaagacctgagttcagatcacaacgctgtattcattactaagaagcctgttcattttaacgttacctggagatattaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccaccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatg

SEQ ID NO: 6552 - DNA, 1589 bp, Homo sapiens
ggtggcggccggctgggcgcgcactctcgggatggagggcgagcgccgggcatcgcaggcgccctcctcgggcctcccggccgggggcgccaacggggagagcccggggggcggcgccccctttccgggcagcagtggctcttccgccctgctgcaggcggaggtgctggatctggacgaggacgaggacgacctggaggtgttcagcaaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaagacatctcgtggggaatttgactccagtgaatttgaagttaggagacgatatcaagatttcctttggttgaagggaaaactggaagaagcacaccccactctgattattccagaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaagggaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatgggtgttatgaaaagaagagaccaaatacaagcagaactggattccaaagttgaagttttgacctataaaaaggcagatactgatctgcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacagtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatg

SEQ ID NO: 6553 - DNA, 1494 bp, Homo sapiens
gccgggtggcgcgggaggaagtcacgtgggagcgcgggctcacatgactggccgcgcgatggacccgctgcccgcggctgcagtcggggcggcagctgaggcggaggctgacgaggaggcggatcccccggcgtcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctacaatagctttcacaagcttcgcgacagggccgagcggatcgcatcgcgggccatcgacaatgcggcagatcttctcatattcgggaaggagctaagtgcaatagggtctgacacgaccccgctgccctcctgggccgctctgaatagcagcacgtgggggtccctgaagcaggctctgaaaggcctgtctgtggaattcgcgctgctcgccgacaaggctgcacaacagggtaagcaggaagagaacgacgtggtggagaagctgaacctcttcttggatctgctgcagtcctataaggacctgtgcgagcggcatgagaagggcgtgttgcacaagcaccagcgggccctgcacaagtacagcctgatgaagaggcagatgatgagcgccaccgcgcagaaccgcgagccggagtccgtggagcagctggagtcccgcattgtggagcaggagaacgcgattcagacgatggagctgcggaactacttctccctgtactgcctgcaccaggagacgcagctcatccacgtctacctgcccctcacctcccacatcctccgcgccttcgtcaactctcagatccaagggcacaaggagatgagcaaggtgtggaacgacctgaggcccaagctcagctgcctctttgcgggaccacacagcaccctgaccccaccgtgctccccgccggaggacggcctgtgtcctcactagcgcctgaggctgaggtggtgctccctgcggccgcactaaaacctctttccaaa

SEQ ID NO: 6554 - DNA, 415 bp, Homo sapiens
gttagcaagaaagtgatgtgttccgggtaggggaattctgttttggtattattttgtctttcctgagaaaagcatcacaaaaagagatgtttgcccatcctgtttgctggggtagtgggaagagaccgggggtgatggtggtgctggctggacgtgggtggtttcacaggacctgctgtgtctgagaggagccatgcggtgattagaagcttggaggctgcagatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatg

SEQ ID NO: 6555 - DNA, 686 bp, Homo sapiens
ccgggggattggtgggacggatggctctgatgtccttggctggctccgcttgtcccttgactctgatttgagtcagaggaaatcatctgagcgatctgccgacaccccaggccatcgagccccaggccatcgtgcagcaggtcccagcccccagtcgaatgcagatgccgcaggggaacccgctgctgctgtcccacaccctgcaggagctgctggccagggacaccgtgcaggtggagctcattccggagaagaagggcctcttcctgaagcatgtggagtatgaggtttccagccagcgcttcaagtcctcggtatacagacggtacaatgacttcgtggtcttccaggagatgctcctgcacaagttcccctaccgtatggtgcctgccctgccacccaagagaatgctgggagctgacagggagttcatcgaggccaggaggagagccctgaagcgcttcgtcaacctggtggcgcgacaccccctgttctccgaggatgtggtcctcaagctcttcctgtccttcagcggctcggatgtgcagaacaagttaaaggagtcagcacagtgcgtcggggacgaattcctgaactgtaagctggctaccagggccaaggacttcctcccagctgacatccaggctcagtttgccatcagccgggagctgatccggaacatctac

SEQ ID NO: 6556 - DNA, 1506 bp, Homo sapiens
gaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgctctacaccctcgccgtgatcggcccaggaccgccagattgccagccagcccagatctctcgccgttactcggactttgagcggctgcaccgaaacctgcagcggcaattccggggcccaatggctgccatctccttcccccagtctcactaagttgccaggctggtctcaagcgcctgggttcaagggatcctcccgcctcagcctcctgagcagctgggattacaggcgcacatcaccatgcccaacctccaagtggacttcttgcaaagggtctggcccagggcagggctgccccacacaagggtgcactgagtgtcgtggctgctccaaatgccccttcatgagcttattatggaccgtcattgaggggtaactcctcccacaggaaccccagttgacagtttaaaagcactttcacacctctcctcgcttcctcaaaaagatcacagagggaggagctctgagaacagtctccttcaacagttcggccaagcagaactgctgtacctctgaccacttgtgttaggaaaactatcggctccctgtataataaatcaagccaggtcctccaagtggtaattcatgaaaaatatccccactaccaccaccaaggggaagaaaggactcagaagagaggacttgaggccatgaggtctggcctcttccctccccatctggagactctttctcccttgctggctttgggcccaagtttgatgtttatgaggatgattgctggtttcccttacacatagcagagctcactcagttctcacagtagccaaatgaagcagttatgtgttgtccagttttccagaccaggactgaaatccagagagggtcaggaatttggccccatgatgaagccaaatctgaacccatgtcctcacttcaaggttatcaatcttggattgtgatgctattggtacttgagaataccccttatctgagtataaagaatccttgagttttgtccttggtttatcaa

SEQ ID NO: 6557 - DNA, 946 bp, Homo sapiens
gatccggtacacagcgtcgcgcgctccccccagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgacacccaccctcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtga

SEQ ID NO: 6558 - DNA, 1043 bp, Homo sapiens
tgagcccggcggagccctgcagaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgacaaacctcagctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttgggg

SEQ ID NO: 6559 - DNA, 1607 bp, Homo sapiens
gaacccggccgacctccatgggctgcggggggctgcacccggacccctggggcgcggcgcgcccctgaatgcaccgtgggacgcaggagggtgccatggcctcccggctcctgcaccggctgcggcacgccttggccggcgacggccccggggaggcggcggccagtccagaggccgagcagtttccggagagctcagagctggaggacgacgacgccgagggcctgtcctcccgactcagcggcaccctcagcttcaccagcgccgaggacgacgaggacgacgaggacgaggacgacgaggaggctggccctgaccagctgcccctcggggatgggacgtcaggagaagacgcagaacggagccccccacctgatgggcagtggggcagtcagctcctggcgcggcagctgcaggatttctggaagaagtcccggaacaccttggcaccccagcggctgctcttcgaagtgaccagcgctaacgttgtcaaggacccgccctccaagtacgtgctctacaccctcgccgtgatcggcccaggaccgccagattgccagccagcccagatctctcgccgttactcggactttgagcggctgcaccgaaacctgcagcggcaattccggggcccaatggctgccatctccttcccccgtaagcggctgcgccggaattttactgcagagaccattgcccgccgtagccgggcctttgagcagtttttgggtcacctgcaggcagtgcctgagctgcgccatgccccggacctgcaggacttcttcgtgctgccggagctgcggcgggcacagagcctcacctgtactggcctctatcgtgaggctctggcactctgggccaatgcctggcagctgcaagcccagctgggcaccccctctggcccagaccgccccctgctgaccctggctgggctggccgtgtgccaccaggagctggaagaccctggagaggcccgggcatgctgtgagaaggccctgcagctgcttggggacaagagcctccaccctttgctggcaccctttctggaggcccatgtccggctctcctggcgcctgggcctggacaaacgtcaatcagaggctcggctccaagccctgcaggaggcaggccttacccccacaccaccccccagtctcaaagaattgctcatcaaggaggtgctggactaacccttgcctagatttaaggccactgtgaggagaggggttgccccagaaggcaggggaaggacctgatgagaacagaatagctgggaggctgcagagggtgctgggagcccctagaagttccaaaagagaatgtgaagcagatcaaggaaacttctgttgagctaggctcagggtgagctttggctggggttgcccttgtgtagtacagggaagtctgacacagcctctccagcctataaacagccggggggctgtggcacaggttggggcaatgttcccttgttggtgggcccccaagctggcaaggcctcttggctgaaggccagggactctgcccctggagtcctggagttaagggatgaaggcaaggctgcaggtctggcccaggggaattaaaagccagccactccagtggta

SEQ ID NO: 6560 - DNA, 682 bp, Homo sapiens
attaaacatggagaaatgaggagcggcggcagatcggtttgggatgcatcttcaggggatgctgaaacaacagcagcatttggtttgctctacacccctgccacccctcgcccgcaagcccagggagtggtcagcagtggggctttgtgacgtcgaagccaccctagggctgccattggctgggacactgcctgtatgatcaaacaaagctcaagggtgtggctttgccttgtcaccaggagggtatacatagggagggcaagagctccgggccactgagaagattcaaaacctacaaaagcctgccgctgacattgaagaaccaatatatacaatggacaaacaatccagtgccggcggggtgaagaggagcgtcccctgtgattccaacgaggccaacgagatgatgccggagacctcgagtgggtactcagacccgcaacctgctccgaaaaaactaaaaacatctgagtcctcgaccatactagtggttcgctacaggaggaactttaaaagaacatctccagaggaactggtgaatgaccacgcccgaaagaacagaatcaaccccctccaaatggaggaggaggaattcatggaaataatggttgaaatacctgcaaagtagcaagaagctacatctctcaaccttgggcaatgacaataaagtttgagaagctga

SEQ ID NO: 6561 - DNA, 4965 bp, Homo sapiens
agctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggaggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 6562 - DNA, 3772 bp, Homo sapiens
acagaagcgacgacgcaggacgaggaggaggacgaggaggaggacctccccggcgcgcagctgccggcagcggggggaagaggaaacgtgcccaacgagaagatcgcgatatggctcaaggactgccggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatggtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaag

SEQ ID NO: 6563 - DNA, 5150 bp, Homo sapiens
ctccccttccttccctccctccctccctgtcccctcctcctcctcctcctcctccggcgcccgcttcagctccccggggccccctgcccggccgggcgctgacagcaagggcgggggtccctgccgccgccttgtctcgcgcagggtccggctggggtagcggagcccccagtgcggccatggaccggcccctgtcgtcgtcggcggaggcggaggaggaactggagtggcaagtggcgagtcgcaggaggaaggcctgggccaagtgccgcagctcctggcaagcgtcggagacggaggatctgtccacagaagcgacgacgcaggacgaggaggaggacgaggaggaggacctccccggcgcgcagctgccggcagcggggggaagaggaaacgtgcccaacgagaagatcgcgatatggctcaaggactgccgtacacctttgggagcctcactggatgaacaaagcagtagtacactcaagggtgtgcttgtgagaaatggaggaagttttgaagatgatttgtcattgggagctgaagccaaccacctccatgaaagtgatgctcaaattgaaaactgcaataatatcttggccaaagagagaagattacagtttcatcagaaagggagaagtatgaattccactggatctgggaaaagtagtgggacagtttcaagtgtttcagaattgttggaactttatgaggaagatcctgaagaaattctttataatcttggatttggacgtgatgaaccagatattgcttctaaaattccttccagattttttaattcatcatcctttgccaaagggatagatattaaagtatttttgagtgctcagatgcaacggatggaagtagaaaacccaaattatgctttaacaagccgttttcgtcaaattgaagtgcttactactgtggccaatgcgttttcttctttatattctcaagtctccgggacgcccctgcagagaattggaagtatgtcctcagtgacctctaacaaggagacagacccacctccacctttaactcgaagtaacactgcaaatcgtttaatgaaaacactctcaaaactgaatttatgtgttgataaaacagagaaaggagaaagtagtagtccttctccatcagctgaaaaaggaaagattctaaatgtttcagtgattgaagaaagtggcaataaaaacgatcaaaagtctcaaaaaattatgaagaagaaagagtcatcttctatgttggctacagttaaagaagaagtctctggtagttcagcagctgttacggagaatgctgatagtgatagaatttctgatgaagcaaatagtaattttaaccaaggaactgaaaatgaacaaagtaaagaaactcaaagtcatgagagtaaactgggtgaggaatctggtattgtagaatccaaattagatagtgatttcaacatatccagccacagtgagctggaaaatagcagtgagctgaaaagtgtccatatatccacacctgaaaaagagccttgtgcaccactgacaataccatccataagaaatataatgacacagcagaaggactccttcgaaatggaagaggttcaaagtacggagggagaagctcctcatgttccagccacttaccagctaggtcttacgaagtcgaaaagagatcatctgttacgtactgcaagtcagcattccgatagcagtggttttgctgaagattctacagactgcctatcccttaatcatcttcaggttcaggagtccttgcaggctatggggagtagtgctgatagttgtgacagtgagacaacagttacgtcacttggtgaagaccttgccacaccaacagcacaagaccagccttattttaatgaatcagaggaggagtctcttgtccctcttcagaagggactagagaaggcagcagcagttgcagacaaaagaaaatcaggtagccaggatttccctcagtgcaacaccattgagaatacaggaactaaacagtccacctgtagtccaggggatcatatcattgaaattactgaagtggaagaggatttgtttccagcagagacagtagagctactgagggaagcaagtgctgaaagtgatgtgggtaaaagcagtgaaagtgaatttactcagtataccacacaccatattctgaaatcattggcttctattgaagctaaatgcagtgatatgagctctgaaaatacaactgggcctccctcttccatggacagagttaatacagctttgcaaagagctcaaatgaaggtttgcagtctgtctaatcaaaggatggggcgtagcctgctaaaatcaaaagatttgttaaaacaaaggtacttatttgcaaaagctggctatcctctaagaaggtctcagtctttaccaaccaccttattgagcccagtaagggttgtgtcctctgtcaatgttcgattatctccaggaaaagagaccagatgcagcccaccttccttcacctataagtacacacctgaagaggagcaggaattggaaaagcgggtgatggaacatgatggtcagtctttagttaaatcgaccattttcatctctccatcatctgtgaagaaagaagaagccccccagagtgaggcgccgcgggtggaggaatgccatcatggaaggactcctacctgttcacggcttgctccaccaccaatgtctcagtctacctgttcccttcattccatccactctgagtggcaagaaaggcccctgtgtgagcacacaagaactctgagcactcacagtgttcccaacatatcaggggctacttgtagtgccttcgcttcccctttcgggtgtccttactcacatagacatgccacctacccttaccgagtgtgctctgtgaatcctccttcagccatagaaatgcagttgcgaagagtattacatgatattagaaactcactgcagaatctttcacagtaccctatgatgagaggacctgatcctgctgctgctccatatagtactcagaaatcatctgttctacctctttatgaaaatacttttcaggagctccaggtaatgaggcggagcctgaatttgtttagaacacaaatgatggatttagaattggcaatgctgcgtcagcaaaccatggtttatcatcatatgactgaggaggagaggtttgaagttgatcagctccagggtttgagaaattcagtccgaatggaacttcaggacctggaactgcagctggaggagcgcctgctgggcctggaggagcagcttcgtgctgtgcgcatgccttcacccttccgctcctccgcactcatgggaatgtgtggcagtagaagcgctgataacttgtcatgcccttctccattgaatgtaatggaaccagtcactgaactgatgcaggagcagtcatacctgaagtctgaattgggcctgggacttggagaaatgggatttgaaattcctcctggagaaagctcagaatctgttttttcccaagcaacatcagaatcatcttctgtatgttctggtccctctcatgctaacagaagaactggagtaccttctactgcctcagtgggcaaatccaaaaccccattagtggcaaggaagaaagtgttccgagcatcggtggctctaacgccaacagctccttctagaacaggctctgtgcagacacctccagatttggaaagttctgaggaagttgatgcagctgaaggagccccagaagttgtaggacctaaatctgaagtggaagaagggcatggaaaactcccatcaatgccagctgctgaggaaatgcataaaaatgtggagcaagatgagttgcagcaagtcatacgggagattaaagagtctattgttggggaaatcagacgggaaattgtaagtggacttttggcagcagtatcttcaagtaaagcgtctaattctaagcaagattatcattaaacagaaattataggttggcatggatcctattagctgtgtaatactggaattatcaatgatatgcactggtggaggtgttatttgtgctttagaagatacttgctgttgagctgggctactgtatacagtgtacaatgtgtatttcttcaaccatatattttaaaaagacgtacatagaaacttaggcactttgctatttcttttctaaactatcaaaaactctagcagtttgaaaagcctaatatttatttgtatgtcagtatttttcatttgattccctattagaattaattttaaaacttgaagacttccagacttatccaacttataaataacatatttcttcagactaacatcttaaaacactgacctctatgaggtatttactgtgcaataactgattcatttttttcagagcttgaagcatccaatgatttttccctccactgctgttaattaatgtcacttccaagaagaaaaactgttctgttgtaaaaaatataattgctcttaattcttggggaggttactaatagcagtaggatagaattttatgaggttacctacaactacttaatgtacttacactgtaagccttgttgctttacccaagacaaatgtaattttatcattgcttatgtagtatttttcttttggaaatgtgccttatgttaaacactatgtacttttactttttgcattgtccagacttctttattagatggagatgtttctttttctgtcttctagactaaatagagtatcatccaaataatggggcctatgacttgaatgaatagaaatgaataagctggtgtttgttttttcaaaatggaagtaatttagatttgttctcctcatacataaaatgattttagttcagttttaaccagtgaaaactttgtttttatgaaaaaaaaggaaaatggtttcccatttggttttatatgtgttaaataaatgtgtaaagtaaccaccaaatgttattagaatttttcttctagcatttataattttttcaactcctattgtgtttctttgtgtgtgatattttaatcaaaagtggttgagttgttaacagtgttctttgaaagaatctctaaaaggcttataaatgtttgaaatatcacacaaaggctgatttctaaaatatatatatattaaaacaataaagtatttattttgcctaaa

SEQ ID NO: 6564 - DNA, 1651 bp, Homo sapiens
agtggacactgtcggcacggtgggctgggggcgtaagggccccggtggtcctagggaccccatggccatggttgagcggccgaggcccgagtgggcctcgtatcacaactgcaacagcaacagctgccaggacctgggcaactctgtcctgttgctgctgggcctcatcatctgcattaacattagcatcaatatagtgaccctggtcagggtggggccagatgggagggagctggtgggatagtggggggcaggcctgccggccagggcctacctgggatcactgtgtcttcccccacctagctctggagccgattccgtggtgtcttataccaagtgttccatgataccatttgtgagaaaggtaagaggtctgggggctgggacataggaggggcagaaaccaagtgctctagcctcagccctaaattagccccttcccttcttgctcgcccctctcagacaacatagctgtgtggctgcccttcctgggccctgcctctccatgcctgtaggagctggcctccccactagtctcacctctcccccatccacagaagctcccaagtcatcattactcagaaagcagacccagccccctaagaagcagagttctcctgcagtccatcttcggtgcaccatggaccctgtgatgatgactgtgtccccgcccccagctcaccgccatcgccgtcgaggctctcccacacgctgtgctcactgcccagtagcttgggctcctgacactgatgacgagaagcctcatcagtacccagccatctgctcctaccactgggatgtccctgaggactgggaaggcttccaacacactcaggggacctgggttccctggtctcaggatgccccagagtcccctccccagaccatccgcttccagcctgggcgacagagcgagactccatcaaaaaaaaaaaaaaaaaaaaaaaagaagagaaatattggggcccccctcaagaggtacctcactgtaacatcacagctctctgtgacctcactcctttgattaactcaccatgtcaccagtgaggagactaagttcagagaagctaagggtcttgctcatggttacacagacactgaggatcaagctcatggcctcagatgctccatcccattgctgcagagccagcctgacccaccagaacctcccaccttccccagttcaccatgtgaactcagaaactgagaaacagagaaactcaggccctgcctttctgctacacaattgggatcatatgcacatgcacacacataccacttgagaacaagcagctgtgtgcgtgagcccaggctgagggagctggacttcaccttccactctagacagattcctggaatgtgagcagacggaccgtttacaaatggccctacttctctcattcaactaacgttactgatcattttcaatggattccattcagtggaatctgaatctactctgcatctactctgtgtttggaggctggatgggatatgatcactggcctttctttctgctgagtggttcactgtgtaaacaaatggcttgcagtctccagggcaccacagaccccagtgatgcacctgttttaagtcaaacactctttttggtatattaacaattacatgtattttgtgctttgttaatttc

SEQ ID NO: 6565 - DNA, 981 bp, Homo sapiens
gggccccggtggtcctagggaccccatggccatggttgagcggccgaggcccgagtgggcctcgtatcacaactgcaacagcaacagctgccaggacctgggcaactctgtcctgttgctgctgggcctcatcatctgcattaacattagcatcaatatagtgaccctgctctggagccgattccgtggtgtcttataccaagtgttccatgataccatttgtgagaaagaagctcccaagtcatcattactcagaaagcagacccagccccctaagaagcagagttctcctgcagtccatcttcggtgcaccatggaccctgtgatgatgactgtgtccccgcccccagctcaccgccatcgccgtcgaggctctcccacacgctgtgctcactgcccagtagcttgggctcctgacactgatgacgagaagcctcatcagtacccagccatctgctcctaccactgggatgtccctgaggactgggaaggcttccaacacactcaggggacctgggttccctggtctcaggatgccccagagtcccctccccagaccatccgcttccagcctaccgtagaggaaaggcccctcaaaacaggcatatggtccgagctgggcctaagggcctatgtgtatcctgtgaaccccccacctcccagccctgaggctcctagccacaagaacggtggggagggggcggtgccagaggcagaggcggctcagtaccagcctgtcccagctcccaccctgggcccagcagtcatccctgaattttcccggcaccgctcctcaggccgaatagtgtatgatgcccgggacatgagacggcggcttcgggaactgacccgggaggtggaggccctgtccggctgctaccccctagcctctggatccagcactgccgaggagacaagcaagaattgggtgtaccgttccctaactgggaggtgactggaaaaaaataaaaaggagagagg

SEQ ID NO: 6566 - DNA, 1987 bp, Homo sapiens
gggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccggggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctgggcccctggccatgggggctgcacctctgggggagccagccaaggaggaccccatgctggcgcaggaggccgggtctgcgttggggtctgatgtggacgatgggacgtccttcctgctgactgctggtcccagctcgtggccgggtgagtggggccctgggttcagggctggtccccccgcgtaagcacctgatatgagctggggaattgggactcaggcctagcgtgtgtcagggggccccagggtctgtgtctgagcccccgttttctccaccgttggtgcttagctgttgggccgtgtctggtattgagcgttataggtgatatgtgagtgtgtgagtgaacgtgatgtggacgagcctgcatgagagctggcggtgcttggagccctgtattcttccccttgaccctgtgtcagcgaggcccctggtccagcccgtgctggccggcaaaggtgtatggccctgtgacatggcgtgtgtccattccatttaggatttagtgtttgggagcccgttcctggttctggtccaacaggtgtcctgggtctggggccaccaggtatgagctcacccacctcatcacagcctctgtgcagcggggacagggcagggcagacggactgaggtgggagctctgttcctccgaccccacctgtctgcctcaagctcccagagcacctgcctgccctgccgatgtgtcctgtttgcttccagggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagcaaaa

SEQ ID NO: 6567 - DNA, 1411 bp, Homo sapiens
gggggcggggctgcctgcggaaggggccgtgcgcgtggggtcgctccgcagctgcgagttcatggcgtcccggtgctccgagccctacccggaggtctccagaatccctaccgtcaggggatgcaacggctccctgtctggtgccctctcctgctgcgaggactcggcccggggctcgggcccgcccaaggcccctacggtggccgagggtcccagctcctgccttcggcggaacgtgatcagcgagagggagcgcaggaagcggatgtcgttgagctgtgagcgtctgcgggccctgctgccccagttcgatggccggcgggaggacatggcctcggtcctggagatgtctgtgcagttcctgcggcttgccagcgccctggggcccagtcaggagcagcacgctattcttgcttcctccaaggaaatgtggcactcgttgcaggaggatgttttacagttgacgttgtcgagtcagattcaagcaggtgtgccagaccctgggacgggagcgtccagcgggactcgaaccccagatgtgaaggcgtttctggaaagtccttggtccctggatccagcgtcggccagcccagagcccgtgccgcacatccttgcgtcctccaggcagtgggaccccgcgagctgcacgtccctgggcacggacaagtgtgaggcactgttggggctgtgccaggtgcggggtgggctgccccctttctcagaaccttccagcctggtgccgtggcccccaggccggagtcttcctaaggctgtgaggccacccctgtcctggcctccgttctcgcagcagcagaccttgcccgtgatgagcggggaggcccttggctggctgggccaggctgggcccctggccatgggggctgcacctctgggggagccagccaaggaggaccccatgctggcgcaggaggccgggtctgcgttggggtctgatgtggacgatgggacgtccttcctgctgactgctggtcccagctcgtggccggggtctctggagggtcgaggaggcagtggccctgcatgggccccagctgagagcagtccactggatgttggagagccaggcttcctaggggaccctgagcttggctcccaggagctccaggacagccctctggagccgtggggcctggatgtggactgtgcaggcctggccctgaaggacgaggtggagagcatcttccctgacttctttgcctgctagcagccaggctgtggagaggaggcgggcggggccggtggatctggagccgtgtgtgtccctgtcgcgtgcttgggcattttattttgggtttgggttgcagctgcaccctaatttgagcgaggcttacaggctgtgagaagaggatagtgaatattaaagagggaaagcagttttcctggaggaagc

SEQ ID NO: 6568 - DNA, 757 bp, Homo sapiens
gcggcagatcactattccctcacaaaccggggctttggggaagccatgtcctacttcaggactccacaaactcatccaggtcctctgccttccggccaaggtggggctgcttctccaggcttgtcccttggcctctgtagtcctgtagagccagtggtggtggcctctggtggaacaggcccactgagccagaaagctgagcaggtggcacctgctgcccaggcctggggcccagccctggcaatgccacaagccaggggctgccctggggggactagctgggagacactacggaaggaatacagccgaaactgccacaaattcccgcatgtgaggcagctggagagcttgggctgggacaatggctactccagaagcagagcccctgacctgggtggccccagcaggcctaggcccctgatgctgtgtgggctgtcaccacgggttctaccggtaccctctgaggcagtggggaaggaggccagctcccagcctgatatctgcatcctcaccctcgccatgatgatcgctggcatccccaccgtgcccgtcccaggagttcgggaagaggacctgatctgggccgctcaagctttcatgatggcccatccggagccagagggtgctgtggagggggcgcggtgggagcaggcacatgcccacacagcctctgggaagatgcccctagtgagatctaaaaggggccagcctcctggctcctgcttgtagatggatgaaatagcaccagatatgtagg

SEQ ID NO: 6569 - DNA, 1100 bp, Homo sapiens
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggtatcactgaacagaacttaagagttatctatttaatggcacatttcatctgacaaaactcagagtctagtttacatattctgaattgctctgctttcttaaaaaaaagagaagggggctactattaaaatgtcattttctagtatttacatgatagagtaaataaaatgaatattgatgtggaata

SEQ ID NO: 6570 - DNA, 1583 bp, Homo sapiens
ccagcagtgagctgtgagttctgtccttgctggctttcccaagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggtcagaaagggttctttgtttgaaatcatctcctttccagcaaagactgctttaactagcataatatatgcttcatatgcagcactaatttatttggcagtctgtgttaatgctgtgctgaagaaggtaaagaacatcttccaggaagaagaatccataaggcaaaacagagaggagagtgaaaattgtagaaaagccttttctgagcctgtgctttcggagcctatgtttgctgaaggtgaaatcaaagcaaaaccttataggtcattgccggagaagccagacatttcagattaccccaagcttcttgctaataagcagagtaataacatccaagttttacattctgtgtttgaccaatcagctgaaatgaatgagcaaatctgaatacaggcattcaaagaacattggctcactgaataggagactttacatctctcatggctgggcagcagctgtgtctggcttccttacttcaagatctgccttgatcacagatcacttaacagtggttaagtttcttattttcaagttcagcaggggcaaactatacacggtcgtccatcaaaatcctggggaagagaataactcatttaatattctgacatgtcaaatgttcttgatagactctgaagagtctgctgcagaagaaccaggttaaaaaaacagtaggtctaaggggttggggtgacaagattctgcatgtctaagaagctcccatgtgacaccaaagttgctggtctatggacaacagtttgaggagcaaggtcttcaagctctcattatggactgaaactggagaaaattctatggaactattatcagctcacacatataaaaactggtcactgagatgacagctgagctgaaatgcccaaaatgcaaatgaactagacatgccaacagcttggggaagagaattccatactgaaagaagagcaaatacaaaagcctgaaggaaagaaaagtcttggtgaatgtgttccagaagactggaacataatatgcaagattggtaaacaggcaggagccaggttgtgcagtgctgtgtatggattttact

SEQ ID NO: 6571 - DNA, 510 bp, Homo sapiens
aagtggaaggctaccctcatctttcactaatggcagactaggacaagcattacccaggcctgcaagcttgttaaggactaggaacccaagcaagaactcaccatgccaatcaaacctgttgggtggatatgtgggcaggtgttgaagaacttttctggaagaatcgaggggatccagaaagcaatcatggaccttgtagatgagtttaaagatgaatttcccaccatcctaagattatcacagtctaatcagaaaagagaacctgcgcagaaaacatccaaaatcaggatggctattgctttagctaagattaatcgagcaacattaattcgtggattaaacagcatatccagatcctccaaatcagtggccaaacttctgcatcctcagcttgcatgcagacttttagagctaagggacatatctggtcgtctgctgagggaagttaatgcgccgaggcaacccctatataacattcaggagaagaaaatggggctccaattgagttaa

SEQ ID NO: 6572 - DNA, 1645 bp, Homo sapiens
gcggccgcgaccgccggggacgagcttggaggaaaaggaaccgggagccgcccacccgggggcgctctccggacccccagggtcctagcgcgcggcccttaccgagcctgggcgcccggatttcggcagcggatcgcctttccgggttggcggcccgcctgattgggaacagccggccggttgccgggggaacgcgggagtcgggcccgacctgagccacgcgggcttggtgcccacctgtgcgcgccgcctgcgaagaaggaacggtctggggagaaggcgccgccggccgcccccgtccccaccgcggccgtcgctggagagttcgagccgcctagcgcccctggagctccccaaccatgaagcccaacttctccctgcgactgcggatcttcaacctcaactgctggggcattccgtacttgagcaagcaccgggccgaccgcatgaggcgcctgggagactttctgaaccaggagagcttcgacctggctttgctggaggaggtgtggagtgagcaggacttccagtacctgagacagaagctgtcacctacctacccagctgcacaccacttccggagcggaatcattggcagtggcctctgtgtcttctccaaacatccaatccaggagcttacccagcacatctacactctcaatggctacccctacatgatccatcatggtgactggttcagtgggaaggctgtggggctgctggtgctccatctaagtggcatggtgctcaacgcctatgtgacccatctccatgccgaatacaatcgacagaaggacatctacctagcacatcgtgtggcccaagcttgggaattggcccagttcatccaccacacatccaagaaggcagacgtggttctgttgtgtggagacctcaacatgcacccagaagacctgggctgctgcctgctgaaggagtggacagggcttcatgatgcctatcttgaaactcgggacttcaagggctctgaggaaggcaacacaatggtacccaagaactgctacgtcagccagcaggagctgaagccatttccctttggtgtccgcattgactacgtgctttacaaggcagtttctgggttttacatctcctgtaagagttttgaaaccactacaggctttgaccctcacaggggcacccccctctctgatcatgaagccctgatggctactctgtttgtgaggcacagccccccacagcagaaccccagctctacccacggaccagcagagaggtcgccgttgatgtgtgtgctaaaggaggcctggacggagctgggtctgggcatggctcaggctcgctggtgggccaccttcgctagctatgtgattggcctggggctgcttctcctggcactgctgtgtgtcctggcggctggaggaggggccggggaagctgccatactgctctggacccccagtgtagggctggtgctgtgggcaggtgcattctacctcttccacgtacaggaggtcaatggcttatatagggcccaggctgagctccagcatgtgctaggaagggcaagggaggcccaggatctgggcccagagcctcagccagccctactcctggggcagcaggagggggacagaactaaagaacaataaagcttggcccttta

SEQ ID NO: 6573 - DNA, 5451 bp, Homo sapiens
ggtctctgggggatgtggtcttgaaggagagacccaggaacctgcgggcggggccggagggagaggggaggacgcccccaatgggcagactcctgggcggggtccgggtcaccattggctccggcggcgcgagggaggcggggtcagaggaatgaagcgcggagctgttcgccgctccaggtgctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaaccatgaccggctggccaacattcgccattgaccagccggagttgcatctcgccaggaggtgacccctcctccagctgcccccaactcgcccaccctcgcccaggaaagtgcccgcagctgccacggacaccatgtagtagggccggctgcggcgcccagtgagctgcgatggttttgtacacgaccccctttcctaacagctgtctgtccgccctgcactgtgtgtcctgggcccttatctttccatgctactggctggtggaccggctcgctgcctccttcatacccaccacctacgagaagcgccagcgggcagacgacccgtgctgcctgcagctgctctgcactgccctcttcacgcccatctacctggccctcctggtggcctcgctgccctttgcgtttctcggctttctcttctggtccccactgcagtcggcccgccggccctacatctattcacggctggaagacaagggcctggccggtggggcagccctgctcagtgaatggaagggcacggggcctggcaaaagcttctgctttgccactgccaacgtctgcctcctgcccgactcactcgccagggtcaacaacctttttaacacccaagcgcgggccaaggagatcgggcagagaatccgcaatggggccgcccggccccagatcaaaatttacatcgactcccccaccaatacctccatcagcgccgctagcttcagcagcctggtgtcaccacagggcggcgatggggtggcccgggccgtccccgggagcattaagaggacagcctctgtggagtacaagggtgacggtgggcggcaccccggtgacgaggctgccaacggcccagcctctggggaccctgtcgacagcagcagcccggaggatgcctgcatcgtgcgcatcggtggcgaggagggcggccggccacctgaagctgacgaccctgtgcctgggggccaggccaggaacggagctggcgggggcccaaggggccagacgcccaaccataatcagcaggacggggattcagggagcctgggcagcccctcggcctcccgggagtccctggtgaaggggcgagctgggccagacaccagtgccagcggggagccaggtgccaacagcaagctcctgtacaaggcctcggtggtgaagaaggcggctgcacgcaggaggcggcaccccgacgaggccttcgaccatgaggtctccgccttcttccccgccaacctggacttcctgtgcctgcaggaggtgtttgacaagcgagcagccaccaaattgaaagagcagctgcacggctacttcgagtacatcctgtacgacgtcggggtctacggctgccagggctgctgcagcttcaagtgtctcaacagcggcctcctctttgccagccgctaccccatcatggacgtggcctatcactgttaccccaacaagtgtaacgacgatgccctggcctctaagggagctctgtttctcaaggtgcaggtgggaagcacacctcaggaccaaagaatcgtcgggtacatcgcctgcacacacctgcatgccccgcaagaggacagcgccatccggtgtgggcagctggacctgcttcaggactggctggctgatttccgaaaatctacctcctcgtccagcgcagccaaccccgaggagctggtggcatttgacgtcgtctgtggagatttcaactttgataactgctcctctgacgacaagctggagcagcaacactccctgttcacccactacagggacccctgccgcctggggcctggtgaggagaagccgtgggccatcggtactctgctggacacgaacggcctgtacgatgaggatgtgtgcacccccgacaacctgcagaaggtcctggagagtgaggagggccgcagggagtacctggcgtttcccaccagcaagagctcgggccagaaggggcggaaggagctgctgaagggcaacggccggcgcatcgactacatgctgcatgcagaggaggggctgtgcccagactggaaggccgaggtggaagaattcagttttatcacccagctgtccggcctgacggaccacctgccagtagccatgcgactgatggtgtcttcgggggaggaggaggcatagaccgtccggagcagcggggcctctgccagcccttgcagctgcagcccatccctgggccatgtcccctccatcgagtgcccggtgcttgggggaggagggcagggacagggagggagccacagtcagtgcccgggaacctggaagctgcgctgctctgcgcctctgggcctcactgtggacagaggagtcaggcccgccccaggagcctccagctgcctaaccagtgccattctttcacaacacgattttctacaaatctacagcacaaccgagtttgtaacccgtgggttagtatgaggaccgggttcgtgtactctctgtatctcctcttaagcttcgtccagggttctttatttttgtctgctgccaatgtcgtctcgcatgcctgcaccctcgcatgcacgctgcccgcatgccacgtgccacgctgtagccacagaccccttgctcgggcctcacccaaggccaaactccaaacacaatcagaaccagccaaagaagcacttcctgggcacggccaccagctctcccgcctccagtgtgggccggctcctgcagggtccgagggctgcatctctaccagccagcccagggctcttcccagggtctcgcattcaagggcaattacattttaaaaagaaaaacagaaaaaggttaatcacaaaaccaaccctcacttcacagggtctgtaagtcactcatagaactttgctcttcccgagacagggtcccttccccagctcaggcacaacagagtctggcaggctctggcaccctgggcctcctccgggagcctcccatctgggcagtggagccataaacggggatccgagaagagagtatccacttttttttttacaggaagaagggactcacagcataaacgggggtgggggggatcctgattttgaaaataatctatttgtagcttctcttctatcaaaaccaacacatcctcttctttctgccaatcctctcccccacgggacacctctctggttcgggaccaatccctccctggggacgtgccccacctgcgtgccggctgagctcaggaacccctgcctgccccccgggtggggctgcggctctggcctcccaggcccatcctcaacagctaccccagccaacaccaaggccacaaggggaccccggcctaggaggcaggaagccaaggtgcagagagcagcctggccctcaccagtgcgcaagctggggcagcaaggctgacagttgctgcatgcccagggcagggtgtggtactggcacccaagttcagcatggcagagctggccaacagcttgtggtccccgatctgcctccagccccaagatgcctacagcccccaggccccttcggcagcactgcctctgcccacctgcctttaagagactccagggctgctcctgtcatgcagcgaaggttttgtctgtttcaaagttcgagactcaacttgagggactgtttttgacaatccccgctgacctccgctcctcgtggcgccctggccctacacccagcctggcccagggccggctttgcctggtgaggctggagggagcaccaggacctgctgtctgctgtcagcccctcctggtgctggtgccctgatgctgtgccttgtcacccattgagctgcaagagggaccaagagggggccacgcagccagccagatgcctggccctgtgctggggcagacaacgctgcagagcccagggagcctggcgctaggacgtgcgtccttgtgacactggcctgtctgaactcacctggcctgggaagcaccgtctgcccgggcccaagccctgcccctccagagtccagagccaggaaggggctgctgagggcgagcatcctgctgggctctctgcccggcccacccctccaaggggctggcctgtgagccttgactgggattcatgatgtggaggcccccaacttccagaagcagctggtactctgctcacacaagcgactgggccggccggccctggacccctagaccccgagccgcctgccgactgcctgcacagggagagcagttgaggcccgggcagggcccccacaccagaccccaacatagcttccccacccaggcaccccctcccggggcagcaggcgtgggagtcagggctgcatgctcctcccctcccacctcacaggcggccttaggcaagtcattttctgtcatcacaaggtcgcctctgcctagtcaggtcctggggtccagagtaaggatgtgcggcccccaggcccccgcacacctccctcagcaccaagaccgggacccccccacccacgtgtctcattgtggctgcctatggactcccgggccttgtgtgcaggccaggcccttccactgattttttaaagtgaaccattgctggatctcagattctgtggcatctaaggcctagcaggggtgggcacacgggtcacccgaggcccataccaagactctgttcctgccctaggcccagtctcaaaggaagccacaaggcgcgggggccactgaggaaggaaatgttcattttcatttgtccaaaaccaccttaagttttaagtatattaatcttgatgctttttaactattgctttttaacttgctgagatttagaaatactgttataaaaacttttttaatttctgtatttttttctgtattgtatcttcatgggacattaggggttttctatggtaagcacacctatggttttggtaaaaacattatcaaatatatatccagacggttcttccctagaagaaaaacaagtctttacacctgataaaatattttgcgaagagaggtgttctttttccttactggtgctgaaaggaaggatggataacgaggagaaaataaaactgtgaggctcaa

SEQ ID NO: 6574 - DNA, 2723 bp, Homo sapiens
tttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctc

SEQ ID NO: 6575 - DNA, 3661 bp, Homo sapiens
atgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggtggcccaatgatgaagttggtttataagcttcaagctgaagactataagttcgactttcctgtctcctacttgcctggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctga

SEQ ID NO: 6576 - DNA, 4896 bp, Homo sapiens
gggcagagacacggccgcagggtcctggggctcgctcgctagcctctgcccggcacacatggacttgagcatctggaagacggcgaggggggccacgttcagcttcagcaggtccaccaggatcctggcggggacagacgcggggccggtgagccctctccgcccggcgcggccacctccctgaagacccgacaaggacgggggcgggggctcctcccgaccagcgggccgggcgtacccggaaagcagaggtcggggggtgtctggctagcatgcggcccccacccgccccgctcacttgaacacgtcggggtcgatagcgccgcccgccgcctgcgccagctcgtacagctccatctcctcggtgctcagcaccttcttccgccgcagcgccagcttctgccgggccgcctccagccccgggggcgccgccgaccccggcccaggccctacgccctgcgccgccatccccgcggcccgcggaaaggtgcgctccgccccgccgcgccccctagcggctgcgcccaccaccctctccctgcagcgtcaacgtctggcctcccgggctgccctggcgggaggggcgggagcgcggggacggggccgcctccgcggcgtcattgaagcccaacagttattgggcgctcacggtgtgctgagcggcgctctaggagccgggagtggcatggcggaccgcaggggtccgctgcttggcgatctgggcctccctgatagactgcattggtcgtgctcgcttaggtggcagcacccagcccagtgccaggcatacattgggcgctcggtaaatgcctctttcaagaaagcgtgcaattttctggtccgcaccggtgcaccactaggggtcgcttttcggggcgggcggggggaaggggggggcactaatcaacaatactgcttacgcgcacgcggattccttgctggggagaaagtaccttggggcgccggaggccgccacaacgcaggcgcattcagctaaggaccactccctcccccgcactcctgcctcgccatttctcttccccgcccggccggccttcgctttgcgcacgcgccttttgaggtaacggcccaaagaggtggaagcgcttttcccgcccggccgcggggcgtggctctgcgcgcagcttgatgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggagctgcacaccatcttcccatggctggtagaaagcatttttggcagcctagatggtgtcctcgttggctggaacctccgctgcttacaggggcgcgtgaatcctgtggagtacagcatcgtgatggaatttctcgaccctggtggcccaatgatgaagttggtttataagcttcaagctgaagactataagttcgactttcctgtctcctacttgcctggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaagagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctg

SEQ ID NO: 6577 - DNA, 1861 bp, Homo sapiens
actttcggcgccgtggcggaatggcggcttccatctctgaggcgagcgacgctatggatcccacagtggtttgctaagaaggccattttcaactctccactggaggctgctatggcgttccctcacctgcagcagcccagctttctactggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagc

SEQ ID NO: 6578 - DNA, 4590 bp, Homo sapiens
gggcagagacacggccgcagggtcctggggctcgctcgctagcctctgcccggcacacatggacttgagcatctggaagacggcgaggggggccacgttcagcttcagcaggtccaccaggatcctggcggggacagacgcggggccggtgagccctctccgcccggcgcggccacctccctgaagacccgacaaggacgggggcgggggctcctcccgaccagcgggccgggcgtacccggaaagcagaggtcggggggtgtctggctagcatgcggcccccacccgccccgctcacttgaacacgtcggggtcgatagcgccgcccgccgcctgcgccagctcgtacagctccatctcctcggtgctcagcaccttcttccgccgcagcgccagcttctgccgggccgcctccagccccgggggcgccgccgaccccggcccaggccctacgccctgcgccgccatccccgcggcccgcggaaaggtgcgctccgccccgccgcgccccctagcggctgcgcccaccaccctctccctgcagcgtcaacgtctggcctcccgggctgccctggcgggaggggcgggagcgcggggacggggccgcctccgcggcgtcattgaagcccaacagttattgggcgctcacggtgtgctgagcggcgctctaggagccgggagtggcatggcggaccgcaggggtccgctgcttggcgatctgggcctccctgatagactgcattggtcgtgctcgcttaggtggcagcacccagcccagtgccaggcatacattgggcgctcggtaaatgcctctttcaagaaagcgtgcaattttctggtccgcaccggtgcaccactaggggtcgcttttcggggcgggcggggggaaggggggggcactaatcaacaatactgcttacgcgcacgcggattccttgctggggagaaagtaccttggggcgccggaggccgccacaacgcaggcgcattcagctaaggaccactccctcccccgcactcctgcctcgccatttctcttccccgcccggccggccttcgctttgcgcacgcgccttttgaggtaacggcccaaagaggtggaagcgcttttcccgcccggccgcggggcgtggctctgcgcgcagcttgatgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaagggtcctgtgaaggcgtccatccaggagtgcatcctccctgacagtcctctgtaccacaacaaggtccagttcacccctactgggggccttggtctgaacttggccctgaatccgttcgagtattacatattcttctttgccttgagcctcatcactcagaagccacttcctgtgtccctccacgtccgtacttcagactgtgcctatttcatcctggtggacaggtacctgtcatggttcctgcccaccgaaggcagtgtgcccccaccactctcctccagcccaggggggaccagcccctcaccacctcccaggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctg

SEQ ID NO: 6579 - DNA, 2350 bp, Homo sapiens
gactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtct

SEQ ID NO: 6580 - DNA, 2342 bp, Homo sapiens
atgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggacaccagccataccctttgcttcctatggcctccaccacactagcctcctaaagcgacacatctctcatcagacgtctgtgaatgcagaccccgcctcccacgagatctggaggtcagaaactctgctccaggtttttgttgaaatgtggcttcatcactattccttggagatgtatcaaaaaatgcagtcccctcatgccaagctggaggttctgcactaccgactcagtgtctccagcgccctctacagccccgcccaacccagcctccaggccctccacgcctaccaagtccctgggcaacagaggaagtgacgcccggggcttctactgggccgagttctcatctggctgtgtccaggatgaggagcaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacgg

SEQ ID NO: 6581 - DNA, 2994 bp, Homo sapiens
atgacgactttcggcgccgtggcggaatggcggcttccatctctgaggcgagcgacgctatggatcccacagtggtttgctaagaaggccattttcaactctccactggaggctgctatggcgttccctcacctgcagcagcccagctttctactggctagcctgaaagctgactctataaataagccctttgcacagcagtgccaagacttggttaaagtcattgaggactttccagcaaaggtttttgttgaaatgtggcttcatcactattccttggagatgtatcaaaaaatgcagtcccctcatgccaaggagtcgttcacgcctactgaggagcatgtgttggtggtgcgcctgctgctgaagcacctgcacgcctttgccaacagcctgaagccagagcaggcctcaccctccgcccactcccacgccaccagccccctggaggagttcaaacgggctgctgtcccgaggttcgtccagcagaaactctacctcttcttgcagcattgctttggccactggcccctggacgcatcgttcagagctgtcctggagatgtggctgagctacctgcagccgtggcggtacgcgcctgacaagcaggctccgggcagcgactcccagccccggtgtgtgtcggagaaatgggcaccctttgtccaggagaacctgctgatgtacaccaagttgtttgtgggctttctgaaccgcgcgctccgcacagacctggtcagccccaagcacgcgctcatggtgttccgagtggccaaagtctttgcccagcccaacctggctgagatgattcagaaaggtgagcagctattcctggagccagagctggtcatcccccaccgccagcaccgactcttcacggcccccacattcactgggagcttcctgtcaccctggccaccagcggtcactgatgcctccttcaaggtgaagagccacgtctacagcctggagggccaggactgcaagtacaccccgatgtttgggcccgaggcccgcaccctggtcctgcgcctcgctcagctcatcacacaggccaaacacacagccaagtccatctccgaccagtgtgcggagagcccggctggccactccttcctctcatggctgggctttagctccatggacaccaatggctcctacacagccaacgacctggacgagatggggcaagacagtgtccggaagacagatgaatacctggagaaggccctggagtacctgcgccagatattccggctcagcgaagcgcagctcaggcagttcacactcgccttgggcaccacccaggatgagaatggaaaaaagcaactccccgactgcatcgtgggtgaggacggactcatccttacgcccctggggcggtaccagatcatcaatgggctgcgaaggtttgaaattgagtaccagggggacccggagctgcagcccatccggagctatgagatcgccagcttggtccgcacactctttaggctgtcgtctgccatcaaccacagatttgcaggacagatggcggctctgtgttcccgggatgacttcctcggcagcttctgtcgctaccacctcacagaacctgggctggccagcaggcacctgctgagccctgtggggcggaggcaggtggccggccacacccgcggccccaggctcagcctgcgcttcctgggcagttaccggacgctggtctcgctgctgctggccttcttcgtggcctctctgttctgcgtcgggcccctcccatgcacgctgctgctcaccctgggctatgtcctctacgcctctgccatgacactgctgaccgagcgggggaagctgcaccagccctgaaggtgtcagctgccttcagagcaggctggagggatttgccacacagccccacccttgggctgagaggacctgggaagcccctccaggagggaacacggtcatcctcgggcttctggagcggggttcctgcagccgcagaggcatctggaggaaacgcaaccaagaaaggaaggcaggtgggccccagcaaaggagtagctgccagggctcaacagctacgctctgtgacagcgcagagctcagcggcggcctttccctccctccgccaaggactcacggccaagccagctctcggggccttttttccactgcccatttggctactctgctgcaccaagcttgggagccagcctgccaacagccacctgggcctggcctccccactggctggccttgaggttggcagagtgggttgtggcgcttcctctctctgtgtgggaccaggacagtggcttaagtctccactccaggaaagaatcaaagtttctagagttgtgagaaaaccagagagtggctgtcctgattcttcactgtgaggggcgttcttcatgttctcccagctgttccaagactgggccgtagaattccatgtttcaggagcctaagaccctcccagagcccaggggcttcaccgcagaccccaagccattgagcacatcacccaaagcagtggccaacatcgcggacccctgtgccttgtcacagatgggtgctggtcctcaggcgttggggacactgctgggtcgatggggtcggattctgccagtttctgctctgcagccaaagatggtcagaagcattgtcacttcagtaacatcaagtgctcaaagacatggcaaccgttcagtggtacttaagtattcaaaatatacaactacagattctctgacagaaaccagcacggggtcttcaccttcattcaccccacaggcgacatgcgagggagaacagcatctcagtggtgatttccaaaccaagcctttgttttcggtgtggggttttgggggtttgctttaatgtttttgaaattgtaaatgttgggctttgtattttgatgtaaactgagcataatggcattttagggcctgtgaccaaaaatgaagcttgtaacgaccatggatctgaataaacatgtccttgcttctg

SEQ ID NO: 6582 - DNA, 658 bp, Homo sapiens
attttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaatcgtgaggatagcttgttccctgttcaatgggggaccagattcgtgtggatgtgaagcattgtttttgttttgtttttctaatatgttggcgccatgaaaatcatcatgttcaaatattagtagtaataaaggtgatatgcctggca

SEQ ID NO: 6583 - DNA, 5745 bp, Homo sapiens
gcggctgccgggcctccaatctcggcggcggcggcggcaacaggggagcctgggtctcgcggcctgcgagtccgtcgcgtgctgagggagacgcaggaggtggagccggccgggtgctcgagggaaggagactggaagctggttccggcgtgaggagagtctgaaaaaggggagcgcggagaggaggctggaagaggaagatgcctagcacagaccttctgatgttgaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtttatggtcaaggtttaaaaagaaatgttttaagctcaccaggaagatgcccattattggtcgtaagattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaatcgtgaggatagcttgttccctgttcaatgggggaccagattcgtgtggatgtgtgacttctgggggaacagaaagcatactgatggcctgcaaagcatatcgggatctggcctttgagaaggggatcaaaactccagaaattgtggctccccaaagtgcccatgctgcatttaacaaagcagccagttactttgggatgaagattgtgcgggtcccattgacgaagatgatggaggtggatgtgcgggcaatgagaagagctatctccaggaacactgccatgctcgtctgttctaccccacagtttcctcatggtgtaatagatcctgtccctgaagtggccaagctggctgtcaaatacaaaataccccttcatgtcgacgcttgtctgggaggcttcctcatcgtctttatggagaaagcaggatacccactggagcacccatttgatttccgggtgaaaggtgtaaccagcatttcagctgacacccataagtatggctatgccccaaaaggctcatcattggtgttgtatagtgacaagaagtacaggaactatcagttcttcgtcgatacagattggcagggtggcatctatgcttccccaaccatcgcaggctcacggcctggtggcattagcgcagcctgttgggctgccttgatgcacttcggtgagaacggctatgttgaagctaccaaacagatcatcaaaactgctcgcttcctcaagtcagaactggaaaatatcaaaggcatctttgtttttgggaatccccaattgtcagtcattgctctgggatcccgtgattttgacatctaccgactatcaaacctgatgactgctaaggggtggaacttgaaccagttgcagttcccacccagtattcatttctgcatcacattactacacgcccggaaacgagtagctatacaattcctaaaggacattcgagaatctgtcactcaaatcatgaagaatcctaaagcgaagaccacaggaatgggtgccatctatggcatggcccagacaactgttgacaggaatatggttgcagaattgtcctcagtcttcttggacagcttgtacagcaccgacactgtcacccagggcagccagatgaatggttctccaaaaccccactgaacttggaccctttctagtctcaaggggattccagccttcagaaggttcttgggatatggaacaggccgtgcacaactttgacatctggtcttgctccatagagcacaactcaagatagaccatgagacagcttgagcctcaggattcttgttcttcctcttatcttccttttgtggtttttaatttgaagaccccagagaattccattacataatgattttgcccttgttataaatgttaccctaggaattgttttaaccatttccttttctaaactctctagctttcaactttacttaaacattgtgtggtagctctgacctgtcctgattctttagagaagctggggtacagtttatgagatagctagagcttctttgttatctcaggcaggaggcgtttacataacagatgtttcctcagctgggtgtgaggtatactctaagcaggaggctttttcagccttctctctcttttttttttttttttttttttttgagatggaattttgctcttttgcccagtctggagtgcagtggcatgatctcagctcactgcaacctccacccactgggttcaagcgattcttctgcctcagcctcccgagtagctgggattaccggcacccaccaccacgcctggctaatttttcaattttctttttcagtagagacgggttcaccgtgttggccaggctggtcttgaactcctgacctcaggtgatacccgcccccccgcctcagcctcccaaagtgctgggattacaggcgtgagccaccgtgcctggccctgtctctcttaagagtaggttcattgtctgtcttagagtcacttctattgcaactcattttctttttccagggcacagatcgaccaagctgccgttccctattctgcaggacaggactattctagcatacctgcttcgtccacccaggcagggtttggggtggtctcttctgtgcctgcagtccccatttgacacttggttgccaccatctttggagattattgtttggaatgatgcttccattggctttttcttgttaccatggactaggaagaaaacatggtttccaaataatctgggagcttttggccatggtgccgccttcctgaattggcagtggtcagagcacacctgaaccctatcctgggctggtgatgagcagaaatcagacctttttctatgcttttttgaatatcagagtaggatgaacacccagattcaaatatgtcaccaaagttggtggtggtccttccctgcacccttgcgttaagccattatgtaatgaaaatgtgtttgcttgaaggaacagctcaaagcaccttcacaagttgccttgacttaccctaggtgggtgtgaaagagcacccgtagcaaggaaaattttctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaatattacgagttttatacttggaaaatggtacttgcttcttttaaatctctgtcttctctaacctcccccttcccatttcaatgctcccttcctaatttcagcaataatctcaaaaagcaattaaatagttaaatgaccctaattgtaattactgtggatggttgcattcatttgattacttgggcacacacgagatgacaaatggggcagtggccatgcttgaatgggctcctggtgagagattgccccctggtggtgaaacaatcgtgtgtgcccactgataccaagaccaatgaaagagacacagttaagcagcaatccatctcatttccaggcacttcaataggtcgctgattggtccttgcaccagcagtggtagtcgtacctatttcagagaggtctgaaattcaggttcttagtttgccagggacaggccctatcttatatttttttccatcttcatcatccacttctgcttacagtttgctgcttacaataacttaatgatggattgagttatctgggtggtctctagccatctgggcagtgtggttctgtctaaccaaagggcattggcctcaaaccctgcatttggtttaggggctaacagagctcctcagataatcttcacacacatgtaactgctggagatcttattctattatgaataagaaacgagaagtttttccaaagtgttagtcaggatctgaaggctgtcattcagataacccagcttttccttttggcttttagcccattcagactttgccagagtcaagccaaggattgcttttttgctacagttttctgccaaatggcctagttcctgagtacctggaaaccagagagaaagaggatccaggatgtacttggatgaggaggcctggcttatctaggaagtcgtgtctggggtgcttattgctgctccatacagctgtacgtcagccccttggccttctctgtaggttcttggcagcaatgagcagctttcactcagtgacacaagtaattactgagtcctaatttgatagccaccaactgtacctgggtaggcaaagtcagatttttgagaacctttttcctgatttgaagttttaattaccttattttcttttatgctttcctctgtcttgtaatcttttctcttcttaatatccttccctataatttcaattatttggattaattttagaataaacctatttatttct

SEQ ID NO: 6584 - DNA, 462 bp, Homo sapiens
agattcaagacaagttgaacaagaccaaggatgatattagcaagaacatgtcattcctgaaagtggacaaagagtatgtgaaagctttaccctcccagggtctgagctcatctgctgttttggagaaacttaaggagtacagctctatggacgccttctggcaagaggggagagcctctggaacagtgtacagtggggaggagaagctcactgagctccttgtgaaggcttatggagattttgcatggagtaaccccctgcatccagatatcttcccaggactacgcaagatagaggcagaaatcgtgaggatagcttgttccctgttcaatgggggaccagattcgtgtggatgtgtaagtatatgcaaggggcatccaatagccttattttttaggttaaaatagaagagtttttaataaatattaattatattttaaaaaataaaaaatattaaaaata

SEQ ID NO: 6585 - DNA, 1877 bp, Homo sapiens
actcagatgctcattgaagaggaggaggaggttgagaaaaggtttctcccatcagtttttatctaattcattcttttgagaggtaaattgggatattcacaatgtatggaaacagagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatc

SEQ ID NO: 6586 - DNA, 1901 bp, Homo sapiens
gacgccggcacacggcgcgactgccgagcgcagcgcccacccgcgggatggctcaggcggctggcccggcgggcggcggggagccgcggactgaggcagtgggcggcgaggggccgcgggagcccggggcagccggcggcgcggccgggggctcccgggacgcgctgagcctggaggagatcctgcggctgtacaaccagcccatcaacgaggagcaggcgtgggccgtgtgctaccagtgctgcggttccctgcgcgccgccgcccgccgccgccagccccgccaccgtgtgcgctcggccgcgcagatccgcgtctggagggacggcgccgtcaccctggcgcccgcggccgacgacgcgggagagccgcccccagttgcgggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagagtgactgcctctttaacggtactgctcattgccagttttatttgggataa

SEQ ID NO: 6587 - DNA, 5664 bp, Homo sapiens
aggcggggcggggcggggcggggcgccggacgccatcgcgtcgctaccggccggcggctgtctgaccgggactgcagccgtgtcctcgccgccctcctcttgcccacgcctcccgggcactcgcctggtcccggcggcggcgcgcgcggccgcgttgggcggcggcggttccggggatggtgaggcggcggcgcgcgacgacgatgctccggagctgaggagacgccggcacacggcgcgactgccgagcgcagcgcccacccgcgggatggctcaggcggctggcccggcgggcggcggggagccgcggactgaggcagtgggcggcgaggggccgcgggagcccggggcagccggcggcgcggccgggggctcccgggacgcgctgagcctggaggagatcctgcggctgtacaaccagcccatcaacgaggagcaggcgtgggccgtgtgctaccagtgctgcggttccctgcgcgccgccgcccgccgccgccagccccgccaccgtgtgcgctcggccgcgcagatccgcgtctggagggacggcgccgtcaccctggcgcccgcggccgacgacgcgggagagccgcccccagttgcgggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagcaatgcggccacttagcatgtcttacagttttgacttgtcagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcag

SEQ ID NO: 6588 - DNA, 5533 bp, Homo sapiens
cgccctcctcttgcccacgcctcccgggcactcgcctggtcccggcggcggcgcgcgcggccgcgttgggcggcggcggttccggggatggtgaggcggcggcgcgcgacgacgatgctccggagctgaggagacgccggcacacggcgcgactgccgagcgcagcgcccacccgcgggatggctcaggcggctggcccggcgggcggcggggagccgcggactgaggcagtgggcggcgaggggccgcgggagcccggggcagccggcggcgcggccgggggctcccgggacgcgctgagcctggaggagatcctgcggctgtacaaccagcccatcaacgaggagcaggcgtgggccgtgtgctaccagtgctgcggttccctgcgcgccgccgcccgccgccgccagccccgccaccgtgtgcgctcggccgcgcagatccgcgtctggagggacggcgccgtcaccctggcgcccgcggccgacgacgcgggagagccgcccccagttgcgggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcag

SEQ ID NO: 6589 - DNA, 5100 bp, Homo sapiens
actcagatgctcattgaagaggaggaggaggttgagaaaaggtttctcccatcagtttttatctaattcattcttttgagaggtaaattgggatattcacaatgtatggaaacagaggtcattgaatctttgggaattattatttataaagcactggactatggtttgaaggagaatgaagaaagggaattaagccctcccctagagcagcttatcgatcacatggccaacacggtggaagctgacggtagcaatgatgagggctatgaggctgcagaagaaggcctgggagatgaagatgaaaagagaaaaatctcagctattcggtcatatagagatgtcatgaagttgtgtgctgctcatctccctactgaatcagatgcaccaaatcattatcaggcagtatgtcgtgcactgtttgcagaaacaatggagctccatacatttctgaccaaaattaagagtgcgaaagagaatcttaagaagattcaagaaatggaaaagagcgatgaatctagcacagacttggaagagctgaaaaacgctgactgggcacgattctgggtacaggtgatgagggatttgaggaatggggtaaaacttaagaaggtccaagagcggcagtacaaccctttgcccattgaatatcagctcaccccttatgagatgttaatggatgacattcgctgcaaaagatacaccttgcgaaaagtgatggtgaatggtgatattccccctcggttaaaaaagagtgctcatgaaatcatcctcgacttcatcagatccagacctcctttaaatccagtctcagccagaaaactgaaaccaactccaccacggccacggagcctccatgaaagaatattagaagaaattaaagcagaaagaaagctgcggcctgtatcaccagaggagattagacgtagcagattagatgtgactacccctgaatctacaaagaatcttgtggagtcatctatggtgaatggaggtttgacatcacaaacaaaagaaaacgggttaagtacctcacagcaggtgcctgcacagcggaagaagctcctcagagccccaactctggccgaactggacagctctgagtctgaggaagaaacgctgcacaagtcgaccagcagcagcagcgtgtctccctctttccctgaagagccagtcctggaggccgtgtccacaaggaagaagcctccaaaattcctgcccatatcatcaacaccccagccagagagacggcagccaccccagagacgacattccattgaaaaggaaacgcctactaacgtgaggcagttcctgccgccttccaggcagagttcccgctctcttgaggaattctgctacccagtggaatgcctcgctcttactgtggaagaagtgatgcatattcgccaggtcctggtgaaggcagagctggaaaaataccaacagtataaagacatctacaccgccttgaaaaaaggaaagctctgcttttgttgccgaaccaggaggttttccttcttcacttggtcttatacctgtcagttctgtaagaggccggtgtgctcacagtgttgcaaaaagatgcggctgccctccaaaccatactccactcttcctatcttttcattgggaccttctgctctgcaaagaggggaaagtagtatgaggtcagaaaaaccctccactgcccatcatcggccacttcggagcattgccaggttctcctcaaaatctaagtctatggacaaatcagatgaagaactccagtttcccaaagagttgatggaggactggagcaccatggaggtgtgtgtggactgcaagaagttcatttcggaaatcatcagttcaagccggcgcagtctggtgttggccaacaaaagggcccgattgaaaaggaaaacgcagtctttctacatgtcctcgccaggcccctcggagtactgcccttcagagaggacgatcagtgagatctgagcctcgtgcctttcagctgcttttgtgctacgagtcagcgtccgtgcgcgaggacactgagccgggctggctctcctttctgtggttttatttaatgggcttgaatttgcattagatcagatttttgccgcatcacattgttccacagactgaatgctgtgttcgtatcgattgatgaaacgtgacaggtccgccaattgctcgtttgcactgagagaggacaacagtttgaaacttacttttgtgtgtgtgtggctttggaagccagtagctacttccttagttcagttctttactgttcctcgaataatctcctgactaaggcaaaaaaaaaaagcttctcctacgagaatcagtctaacagagatgccgatgtcagcacagccctaagcagtaagtcatattggcatttccacgtgactgtgtttctatcccgtgtacagagagatccagagccctacactccacgacctgggggctcacagcacagaacctagaagcacctgctgacactcttcaactgatttttaaatgttgttgcttggagataaaaattacataagggactttttgcctgcattctagtgcaaaacatctgaagagctgtacacccacaagggtgactatttcccctgagtggccgtgttgtcccagtgccctggttcagtgtctcctgagtggatgacaggtcttcattctctatcttgaatgtattatggttactaatagttttataatggaggtctaagaattaaagttgtgtgggagtttcaggacaaaggaaggctaaaagtttgtcaagacgttgagcgtattttggttacctatgagaagggttgtgacagtgtacagtggcagctgttggccacgctgcagaaatgagctggagctcatgggttttcagctacatttttcataactttgtagtacatccatcttgagtaaattaagccacaatttggtacctagggtctcaaactaaaatttatttttataaatgaattttaaaagaaaaaatatctacttcttttaaagttagaagaaaattaacctgctgacaggcaacatttttggggtgctttctgcactagttttccttgtaaatgatttgagtgagtaggtttggtttctgacgaaagtagactggagggtagcattgtatgcctcaaatgtctcagtgtgtttggctcatacgtgggctatactgtattattttggtatgcttacaaatgactaaccaatcaaattgtcattaatgtttggaaaatctgttaatgcacatgcacaataatttcctgaaagccataggacatgtctgtagtcagcaccacgatagcaccgtttcatgaaaggcatggcggctgcatttcataccacatcaaaatacagtaacatttctatactaaattaacagtaatacctcaaaactgctccggtagtagtttttaatggattgaaatttacagtttagtaaaaggcttaaaattacttatacttatgaaataaactttaccagttgactaaaataatgcatgttaacagttggtctgtatttgcatgtaaaagtgggccaccagagaacccttattgattacttaagtgtttacattattttaaagactcctgtttaagagctttcagaattgtactgggtgaatctcatttataaaacttcctaagagactatctgaactctatactccagacagttaggtgggagtataaatctaccccttttgatgaccccaggcttgagtttttaaaatgactacccagaagggcacaagggggaaggaaatggtatttgtatatgtatataaatatgcacctaggagaatgtgctttttaaaataatgactactgtttttattaaaacataagaaactacacccccaaaataagactttcattcacattcacaaagcaaacatctagtacatgtctttcacttcactttatgatagtgtattggatgatttgggcattacgatcacctcttaccacagcacagaacatacattcttcaacagcattaacggagtttgccaagtgcattaaagaggtcacgtggagggtacgttcatatgaaacaatctgcagaaagtggggtaagaaagggcacatggcacagttaaagttgtagaaatcaaattactatcattttttgttgccaaaacaaagtcttacatttaacccccctttctaccacccccctccacacttcacgtcagctacatagtttccacagggtaattcactaagagcttgtggagcttggttttaaaatccttagcctggtctgactttaggcatagcttccagttcttccttccgtgtcctggtttcttgttcagttttacttctaatccaacaacaaaagaaatgtctggctggtctcagctagagtctgatgtgtcttagagcatgtgtgcgtatctgaaccatcatccctgctctcatctcagctccctccaggcctgagcaccggttccttttgtcccatacgtcatgaagtcacactattgggaaacctgtgcttccctctccatggcttaactccctgtcagtgtcggagtgtataagaatgcttgtaaatactgtaatatatttattaatatttgaaaggcattcattcagtggacagtgggaattaactctcccaaggcaagtgaaaatgaatgattgacgtacgttgatttaacaatcttactagattttaattcttaaggatttcaaatgaaaccagaaggtggttatgtaagaggcttaaaatgatcttatgtttaaagagattctgttattagcaccatgaactcgtactatgaaatttttaagccttttatttttctaactatattactgtaggactggatattaggtgtcatataggaaacacaaaagtttattgctgtttgctaaagcaaaatagcagaaaattttgtatatgcaaaactgttgaaggaccatagagaaatgtgtactactgacggggcttttactaggcttcctgcgtgtgtaaaagtcgaggtattgctggcattcagggtgacatgatggtactaaatgttttccattaaagtcttctattttaaaatttagagaaaaataaaatggctttccatcaga

SEQ ID NO: 6590 - DNA, 2101 bp, Homo sapiens
acgtgctaggggagcgggcgggcagatggctgtgtctgtaagcgggaggcgtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatatgggtgtcaaatatggcttggtgggattggagcccaccaaggtggccttgaatgtggagcgcttccgggagtgggcagtggtgctggcagacacagcggtcaccagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaactactgccaatttcctaggctaccatgggtgtatcttccttgacctgcttccttcagtccctctgcctccctttgcccaggcctttctcagactgtattccatcctggggtcttatcattcagctttgtttgaatttattaatcaccatgatacctctccctccctttgtccacatgtaacttgttcttggggctctaccagatggctgaagagtaaatcctttctacctctggctgaaggagtggtgcagtcaatgacttggccctttttctacagcacatttagagtttgggctctggctccctcagtaagtgctttattaactcagtgtgtcaaaatgaaaacagagccctccttccccagtagctcagtgccacagaccttcagccccacacagctgtagctatccttaccctgagtccatctaccttaaatctgtacctctgacacccagccagtctgtcataatcattatcccagttataaccttgaccaaaggggaagagagacacttgggggatatctaggggatgagtgctagaaactatttatttatttttgagacagagtctcactctgtcacccaggctggagtgcagtggcatgatcttggctcactgcaaactctgccttttgggttcaagcgactctcgtgcctcagcctcctgagtagctaggattacaggtgtgtgccaccatgcccgtctcatttttatatttttagtagagatggggttttgccatattggccaggctggtctcgaactcctggcctcatgtgatcagcccaccttggcctcccaaagtgctgggatttcaggcgtgagccaccacacccggccaaaactgtttattcttgagaagttccatcttcatttctgccacagttggaacttcccgaggaaggaaggaggcctgaggttttgcacaatctgtttcagagcctgtttagactcaaacctatgcttcccttggcagcagaatacacttaacctaaagcagtatttggagttgagaaaaacctggtggggtaagtgaatatgtactgtttggtagggtaggtagagaagctgtgctttgaccctgtgattccatctttttctaccttctatgatggtgatgaagctagatacccctagggaagaaagaaggactgggtttagcaaaaatgatttggtaattaaagtttatttgaac

SEQ ID NO: 6591 - DNA, 876 bp, Homo sapiens
gtgcccggttcatccaaggcgcaagatggcgctgctttttgcacgttctttgcgcttgtgccgctggggagccaaacgattgggagttgcctccacagaggcccagagaggcgtcagtttcaaactggaagaaaaaaccgcccacagcagcctggcactcttcagagatgatatgggtgtcaaatatggcttggtgggattggagcccaccaaggtggccttgaatgtggagcgcttccgggagtggcagacactactgggaagtgacagtgaagcgctcccagcagttccggataggagtggcagatgtggacatgtcccgggatagctgcattggtgttgatgatcgttcctgggtgttcacctatgcccagcgcaagtggtacaccatgttggccaacgagaaagccccagttgagggtattgggcagccagagaaggtggggctgttgctggagtatgaggcccagaagctgagcctggtggatgtgagccaggtctctgtggttcacacgctacagacagatttccggggtccagtggtgcctgcctttgctctctgggatggggagctgctgacccattcagggcttgaggtgcccgagggcctctagtatgtccattactggagtccctaatcacgcctttggccagcctccttttgaaagtgtccgaagcctttttactttgcctcaagcaacctctagctcccacaattcagtgttgggtcctctgtgcaatatcatgatcatcttcctcatcccctaccttgtgaaagctaggcatacagccaaaccctccttttccccacccaccaactactgccaatttcctaggctaccatgggtgtatcttccttgacctgcttccttcagt

SEQ ID NO: 6592 - DNA, 2366 bp, Homo sapiens
ctgagcgggggagcggcggcccccagctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctc

SEQ ID NO: 6593 - DNA, 2194 bp, Homo sapiens
tttaccaataatcaaataaaagcaaattagagccacaatagtatttttgcccattttcttagcaaagacttaaaagtttgataatgtccttgtttggcaggaatgtaggtagaatgatcagctggcactttttctggaggatattttggcaatattaaaccattttaaatacgaatcatctctgacccaccaattttacactaaaaacattattacaaggaaattagagaaatttataaagatggatattctaggatgtacactatagcattaacagcagaggactaaaaacagcctaaatgttcattattatgggattgtttaaacaaattatgataaagtcaatgcagtattgtctgttaaggatgaagaatataggaaaacacctccatagtatattaagtgagaaaataaacatacaaaacactaggctgggcgcggttgcagacgcctgtaatcccagcactttgggaggctgaggcgggcagatcacctgaggtcaggagttcgagaccagcctgaccaacatggagaaaccctgtctctactaaaaataaaattagccaggcgtggtggcgcgtgcctgtaatttcagcctcctgagtagctgggactacaggcgtgtgccaccacacctggctaaattttgtatttttagtagagacagggtttcaccatattggccaggctggtctcaaactcttgacctcgtgatccgcccacctcggcctcccagagtgctgggattacaggcgtgagccaccgcacctggcctagaaggggaataccttttaacttggtgtaagaattgtcaggctgccccttgaaagtgtgtgaacatcacagaccatgttttagagcctagattcctgacttaaatggagagttggactctaaagttcatgatgtataaaattatgtgatgtatgaaattgcagcccccaatgtagctttcatgactctgcgtagcatgtgtaataccagcaaaatggtgacttgtgccaaaatttttttttactttttggtcttcttttccctttctcagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtattt

SEQ ID NO: 6594 - DNA, 2318 bp, Homo sapiens
tgcgagagcatataaccagcatgtcttgagtcttttacccatgtgcctgttatatggatgctgctgtttttgtaagatgaaatgacccttggatattctgggttatgatcagcatttcttcgtctaggcgagaaaagaaacagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctc

SEQ ID NO: 6595 - DNA, 2225 bp, Homo sapiens
tgggcaaccattatcctgtctcgccgccacccaggacatggcttctgttccaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctc

SEQ ID NO: 6596 - DNA, 530 bp, Homo sapiens
gtgatgtggggccgctggtagaaatttgccggtgaccttccctgcaccctctctgcagccagccttgcggagaagacaggttttggcgaccttttgatttcttctgaattcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttct

SEQ ID NO: 6597 - DNA, 989 bp, Homo sapiens
agtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagaccttatctccctgcggatggcattgcgtgcagttaattatggccagatggactcagccgcttcttcatcgtcttctctcggactctgcagacctacaccgtgcctttaaaggaagcagggccctccctgctgaagcattcagtgagcccaggcaccagcatcttcaaaccgagtcttttctctccttagtgctgctccccgctttccaggccttcctgggatatcttagagctcctgaaggtgcggcactcgccttgaggcactttcttctgagctgtgagctatgggcaagcagtggagggggaagagagcagctgaagcagatgccggttcaacttacttaaagatgtgggacaagctctgaggaagcccccaagacaatgatgtctggttgtgcaccattgaagcaagaacagaaaccatcccagagtggaggacatggcccatgtggtcctcctgttctgagtggctatgagatggagttctgtgtgagctctctacagaaaaagccctgtctccaggcaatcagtggagatctgttaaacgagttgaaacaaaagaggacaaggaattgctgtggctttagacgttgccaggacatgtagaaactcactcaggatttactactgcatccactgtcacttaggcgcaggaggggtcacagtca

SEQ ID NO: 6598 - DNA, 2542 bp, Homo sapiens
ggttcctcccttcccaggcagagactgataaactcagcacttgccggagtggctcattgttaagacaaagggtgtgcacttcctggccaggaaacctgagcggtgagactcccagctgcctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggacgtccgctacttgcacttcctggaaggcacccgggactatgagtggctggaagcactgcttatgaatcagacggtgatgtcaaaaaaccttttctggttcaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtg

SEQ ID NO: 6599 - DNA, 2319 bp, Homo sapiens
ctacatcaaggccccaggacatgcagaaccttcctctagaacccgacccaccaccatgaggtcctgcctgtggagatgcaggcacctgagccaaggcgtccagtggtccttgcttctggctgtcctggtcttctttctcttcgccttgccctcttttattaaggagcctcaaacaaagccttccaggcatcaacgcacagagaacattaaagaaaggtctctacagtccctggcaaagcctaagtcccaggcacccacaagggcaaggaggacaaccatctatgcagagccagtgccagagaacaatgccctcaacacacaaacccagcccaaggcccacaccaccggagacagaggaaaggaggccaaccaggcaccgccggaggagcaggacaaggtgccccacacagcacagagggcagcatggaagagcccagaaaaagagaaaaccatggtgaacacactgtcacccagagggcaagatgcagggatggcctctggcaggacagaggcacaatcatggaagagccaggacacaaagacgacccaaggaaatgggggccagaccaggaagctgacggcctccaggacggtgtcagagaagcaccagggcaaagcggcaaccacagccaagacgctcattcccaaaagtcagcacagaatgctggctcccacaggagcagtgtcaacaaggacgagacagaaaggagtgaccacagcagtcatcccacctaaggagaagaaacctcaggccaccccaccccctgcccctttccagagccccacgacgcagagaaaccaaagactgaaggccgccaacttcaaatctgagcctcggtgggattttgaggaaaaatacagcttcgaaataggaggccttcagacgacttgccctgactctgtgaagatcaaagcctccaagtcgctgtggctccagaaactctttctgcccaacctcactctcttcctggactccagacacttcaaccagagtgagtgggaccgcctggaacactttgcaccaccctttggcttcatggagctcaactactccttggtgcagaaggtcgtgacacgcttccctccagtgccccagcagcagctgctcctggccagcctccccgctgggagcctccggtgcatcacctgtgccgtggtgggcaacgggggcatcctgaacaactcccacatgggccaggagatagacagtcacgactacgtgttccgattgagcggagctctcattaaaggctacgaacaggatgtggggactcggacatccttctacggctttaccgccttctccctgacccagtcactccttatattgggcaatcggggtttcaagaacgtgcctcttgggaaggcacagaccccaggaagcttttcgggaagccctgcacatggacaggtacctgttgctgcacccagactttctccgatacatgaagaacaggtttctgaggtctaagaccctggatggtgcccactggaggatataccgccccaccactggggccctcctgctgctcactgcccttcagctctgtgaccaggtgagtgcttatggcttcatcactgagggccatgagcgcttttctgatcactactatgatacatcatggaagcggctgatcttttacataaaccatgacttcaagctggagagagaagtctggaagcggctacacgatgaagggataatccggctgtaccagcgtcctggtcccggaactgccaaagccaagaactgaccggggccagggctgccatggtctccttgcctgctccaaggcacaggatacagtgggaatcttgagactctttggccatttcccatggctcagactaagctccaagcccttcaggagttccaagggaacacttgaaccatggacaagactctctcaagatggcaaatggctaattgaggttctgaagttcttcagtacattgctgtaggtcctgaggccagggatttttaattaaatggggtgatgggtggccaataccacaattcctgctgaaaaacactcttccagtccaaaagcttcttgatacagaaaaaagagcctggatttacagaaacatatagatctggtttgaattccagatcgagtttacagttgtgaaatcttgaaggtattacttaacttcactacagattgtctagaagacctttctaggagttatctgattctagaagggtctatacttgtccttgtctttaagctatttgacaactctacgtgttgtagaaaactgataataatacaaatgattgttgtccatggaaaggcaaataaattttctacagtg

SEQ ID NO: 6600 - DNA, 2105 bp, Homo sapiens
ggagcgcgcgctctgggcgccgggacgacactccagccccgggggacccgccgcccagctcccgagggtgcggcagcctctggccactcagccggggccgagagggagctgccgggcgggcaggcgccgcaggcacccggcgggcagggcggggcagggcaagacggccgcctccgcaagtgccacccggcccacccggttctctcccttctgcctgggacgtcagcggacggggcgctcgcgggccggggctgtatggggctcccgcgcgggtcgttcttctggctgctgctcctgctcacggctgcctgctcggggctcctctttgccctgtacttctcggcggtgcagcggtacccggggccagcggccggagccagggacaccacatcatttgaagcattctttcaatccaaggcatcgaattcttggacaggaaagggccaggcctgccgacacctgcttcacctggccattcagcggcacccccacttccgtggcctgttcaatctctccattccagtgctgctgtggggggacctcttcaccccagcgctctgggaccgcctgagccaacacaaagccccgtatggctggcgggggctctctcaccaagtcatcgcctccaccctgagccttctgaacggctcagagagtgccaagctgtttgccccgcccagggacacccctccaaagtgtatccggtgtgccgtggtgggcaacggaggcattctgaatgggtcccgccagggtcccaacatcgatgcccatgactatgtattcagactcaatggagctgtgatcaaaggcttcgagcgcgatgtgggcaccaagacttccttctatggtttcactgtgaacacgatgaagaactccctcgtctcctactggaatctgggcttcacctccgtgccacaaggacaggacctgcagtatatcttcatcccctcagacatccgcgactatgtgatgctgagatcggccattctgggcgtgcctgtccctgagggcctagataaaggggacaggccgcacgcctattttggaccagaagcctctgccagtaaattcaagctgctacatccggacttcatcagctacctgacagaaaggttcttgaaatcaaagttgattaacacacattttggagacctatatatgcctagtaccggggctctcatgctgctgacagctttgcatacctgtgaccaggtcagtgcctatggattcatcacaagcaactactggaaattttccgaccactatttcgaacgaaaaatgaagccattgatattttatgcaaaccacgatctgtccctggaagctgccctgtggagggacctgcacaaggccggcatccttcagctgtaccagcgctgaccccaatgcactgagccctttgcttcttcaagagttgcggccctgatcctctcaagtggccaaaagcttttttaacttttcaatcttcaccttcccttgccaacagagggcactggggtgaattcaagattttcatcgaggtctgttcaatataggacaccccagcttgtccttggctcatccaagaactcttctgtatctaaaacaatacatctcaatcttggccaagggaaaatggactgctttgctggattggcactgagcaactttaggaaatgtcggtggagtgttcagcaagatcagacagcagtccaggtcaaaggcaaacacacacgctccagcccaaatcctcctggtggcacatcctaccccagatgctaaagtgattcaaggactccaggacacctcttaagagcctttctaagaacatgataggcttacttctgctccataataaagtgggagaaaaaagccagaatataacttaagactagataactgcgtacatgatggaccatttttttttttttggctgggtagagaaatcatataaaacgcaggctgtttagcatggagatgactctcagaacactgggagggtctggcacttgatgggggttagttgcttggcagcctgcctgccactgagggaagtcccattagagatgtatcaccaccttgtcaccaacaggatgatgtcaccaggtaataaaccttcatcctca

SEQ ID NO: 6601 - DNA, 6861 bp, Homo sapiens
gcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaagagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttccttctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttgataatggttttcctgatcttgccgcatcacttaatgtgatccccatactgcaactgtgatgctgatgatgctaatggagatgatggtaatgataaagacaacaacaatgattatcaagttcctgtacactctcagatgtggatggtgactctgctagtaatttaaacttggcatttcatggaggatggttgtgctcatgatgttctttctggaggttcaacactacgtaccgcactttataatttaactggaattgagatgaaggccagtgacatgacaactgtgacctaagaaatgggaagattatctttcaagatagctgcctagaattgttcaacagtgagtaacttccagaagccaaaagagtttggcttcatgaggcaaggtgattgactcaatggcttgttgaatctcagcagttccgccatcttgaagaatgattgattgtcaaacactgacccaagaactgctatcagggtgcaagtatcttactacttagcctaaggatgggaaaatatctcttcctaatataccatctttctacagtatttcctacagctaaagcctcaggccattgcctaattaacaatgaagatttcatggacatcctacacttcaggattacttgactatctcaaacacataaatcaaaatgggccaagtagcaaatcttgatgaatttccactcttaccatccattcttactaccaacagtataactgaacatgtgattagaatgatctatattaatgtttagttatttttggttgagtgctaaatatttcagaaggctacttaacatgtaagataccaacttcaacactgtaataacatatactgtgaaaacattcctaaaaagtaaccaaagggtttgctaactctgcttcaacatccaacaacacaaaactatatgatttttaaaatcatgaaatagagacagcaaagcatatttttacatcaatttgtatcctatcatacttcataatatatatttgtatattcaaatttctattttataggcccaaggtgtgtttctccaaacattacattctcattgccaagtgccagctgttacacatggagaggaaatgattccttatattaaacctgaccagagctttttgccttctagggatttatttttcccatagtgtatcagttgttatgccacaataacaacaataataatgttcttaatgtccaaagtgctttgtcatttagagtcctttaacatctgttataccatgtgatgcccttgaacaccccattgggctattgtctgtgtattctgctctctttagcagatgatctgtaatttggtcattgttctgttatattccagattgctctacttgctaatatttgtatagaatagaatttatgtaaactagtaaccagttgatctctgtgccaaatacattatatcaggattacacaaaaagtatcacaaaggatggtcttggccatatgctagggcccctgtgaaaataagtagttttgagaagtttttctatatacgtatatatacacgtgtggttctatttaggtggggaaaaaatgaaaaagcagggacaacaggaggaaatgaaggcagagaaatatagtttcctttcctaggattgagacaattctatttttcatatactcgttgctcattaaatagtaaagggttgatttgctgcaagagtagctgagaattcaaaaacatccttgcagaatgattcaaaagacaaaagccaggctcaacttatagaatgttttggaaactggaagtaatgatacatttcacttcagaagcacttgtaggtctttactagtgctaagtattatggtgagctatcattaaagtgtgccatcttggataaaggccttttgcctactctcttctgcaattttgacacctcaatattcacacccataaacattactaagccccagttctatcgttggaaggagttgttattcttttgttgttcccttatgcaatttttaattctatgaatgttaagtttttttgagctaatgatagatagaaatgcccactcaaagaaaaataaacagagacaaatgttaaaattgccatacagactgtttttccccctgttgtttcactttaaaataaaaagaaatccttgattaatcagaatggcttgggacatgaacttaatttatttagttttctaataaatgaagggccaactcttatttgttctagcccctactgatgagaaacatttgaaaacttgcttgctctcctgcctcgttgtagctttctctgatgaagacttctgcagtatattgtatccctcactctatagcagaaggtgtgtgtggaatatgtagactccagtgttttcttaggaggggtgggaaagggctttctttcctctcctctcctctcgtctcctctttctttcctttctttttgcaactaaactgctactctacactttttattgttgttttctttgtctttttctttctacaaacaggaaacaaaaaaaaaaaaaaacaagtttttctcaatttggagactcaattgaataatttccagtataatcagcattttgatagaatctcacaacttatttttctctgcttttatttcctgtttttctttgttccatctttctaattctagtgaaaatgcaaagtctaatttctcccatgttgagaataaatttttcatctatgatttgctgatagagaagagcttggtaagggagcaattcaaggaaactattttgccatgcacatttctgatcaattcccacagattctggtcaaatgaaagatattctatccaacatttaaacattgaaaaatttaactgaacttacttatcactgatgtgtatttatcccagaaattaattaatatctgtgaaaaataaaaatatttcaatactatccgtgcttcttggaaaatgaactataaaaaagggtcacaatttttctgaaattggcatgaaaacattcaagataaaaataatagactaaacattattttctgttatgcataattctatgaaaaagcaaggtaatttaaaaagagttttaaaatgtgtgtttgaatcttttccaatttaaccaagtgagaagtagcaatgatttacattgttatgatgataatgtgaataagaaaccttttagagtatatgattttacattgctatcaaacctatcaaagaaaaggcaattggaatttggaggaatgtttgtatatatgcacatagagtctatttgtgtgtgtgtgaacgcacatatatatacatctatatacttataactatatataaaagcatatatataatcctatattcttcactggtgcatgtgaatcacagaaagccctattttagacttcatctgaaattcgttgggttacattttgaatcctgatgaaaaaagcaaaaatccaaattaaatggactgattgctaagagtacgtaaaatcatattcaaaagctggccagaagaataaagctagagaagctgctaaatctagaaaacacaatcagatgccacagttgtcacaaatcagacttgtaagtatagcaatctgtattgtaggttctgccgattgcaggcttagctaaagtcacattgaaaaacattgcatcaagcttcattcacactgaagtaaatgaacattggtcctcctattcaaataagccagtctttagcataagcaaaatccagatttgcatgatttttattatatagctacagaactgtgaccactgtgaaaaaggaaaattatacaaggagattgctcttggaggatttggtatgaatcagctgaggtaggaacaagagtctgaattggggacctgctgaccttccaagaagtagaaggccatcagaagaaaatcactgttacttagagaagagacaacactaaagtacttcacctggtagtgttaattggatgttaattatgagctcggtttaatttcaataagcaagaaaatataatcagatgactgatttaaaaaaaaacaacaacaatgtgcccatctagcctttaatgtgacatgtcaaatgcaaataataaattatgttattcagtatcagttgtttgcatgtcttagcacaacaaaggatttacagtctgagggccaagagagaaaaaatgcttttttcttaaaacagcatatttaaaagacaagacctcatcatttcagtagtgtacatagattagtgactgaaggagccagtgctagcctttttaagtaggtcaggcttttagagctgaaagagattttaaagaccagccaattcaactcctacaccttggagctgaggaaacagacagaggtgaagtgacttgcctgtagttataaactggactaatggcagtactgagactcaaattcttgtctcatgttttcttctctagtgctttttccactacactttttagacagaagagtagctggaaaaagaatgcctaactgatttactaaagagtctattcatggaatccaagggctccaaattgtgctaattctgctcaggatgaaacaaatccccacgctgaagtggagaaatattttcataattgaaggaacatatcccattgattgtctacactttcttctctctgtttgttgctattggtaaggctaggctatgttctgttatcacaaaattctaggacttgtttaaagaacttaaaggtcagtttcttagtttctctttgtgattgaggatgagcaagccattgatacaccaagagctgctgagtgttggaggttgcctggtgaaactggcaggccctgttgttgacatttccccagagctaaaatgtcctcatactcaaaccaactgtgctgcccaagttagtgaaattatccatcagcactaacaccaccctttgggttcatgctcatccctgcactccatgtgacctttgagcccagatacccttctagaaggtgaatgaaagccccacatgtcccgcaagacttagtctgcataaaagatttaaaaggatttttttttctctacagtccatttatatgatactgttagaagtgaagaattttgaaactacatacactggcctctgaaaatggttcttgtggctcagaaatagtatattgttctgttgcttgtttttgctgaactgtagagaaaacaccagagtaaaattccatgtaaattgctaaggcatcgaatcagaactgtccttgggcgttgtaacagtgcagaaaatctcatttagtttttttctttttttttttcagttaactacttgtttgtttcttttcagaataggcacttttttttgagtagaaaacctcttctttctccacagatacatctctttttgttcacgccttgaagacttcagaaaaatagaagctcacttccttccataaaggtgaagaacatcttgatgaataaacagtcaactaccaagttcacatatttgcctatgaagtgagagctatttctaagaaacttcaaaaagatcaaaacgaggcaattttatagctttttgttacctaatctacaaagtactaatttccttgtgtttagctttgttgtcactgttactgagtaaatacccatttctgttacatatggtacattttttgcttcacttattttcctgagttcccatgattttttttctgtagtttctcattcattttaaaacccataatcttcatctatttttagaagaaagtgtaaatgcacagttgtacgtttgttgagagtttttatggcattatagtgctttatttataagcattgtgtcttagaataaagcttacaaaatggcaaa

SEQ ID NO: 6602 - DNA, 915 bp, Homo sapiens
gtatgcatacgtaaaagaaagtctgtgattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagagtccagtctggctcatatctcagcacagggtggtttaccttccttctggccatggacgcctgttatggcattcacgtctacgggatgataaatgacacctactgcaagacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttga

SEQ ID NO: 6603 - DNA, 1146 bp, Homo sapiens
ggggtctgtggcggcgcagcttacaccgcggtccccttatttggatctgcgggaatgtgggctggagaggtcctgccgtggtaccagcctccagcctgcccccaggactgcccctgacccaggcgcgcccgctgctcggtggcaggagggccggcggagcgccatggcctgcatcctgaaggtaacgacttggattgctgtgagcttcatagcagcgttccttttcctgctggttgtgcgtcttgtaaatgaagtgaatttcccattgctactaaactgctttggacaacctggtacaaagtggataccattctcctacacatacaggcggccccttcgaactcactatggatacataaatgtgaagacacaagagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacagtacagagtgaccatgcagtgttgattgatcgaacagcaaccaccacatacatgtcctgccccaccacaaaaggaaggaaggaataaaagaaagaaagaaagaaacaaacaaacaaacaaacaaaactaagcaagacaaaacaaatacccatgtcagtggttcaaagattaagattgtggctttgtgtaaagttctttccctttgtagacttgctgcataattattcaggtatgatggttacagtttttaaaaaggaagggaaattgtggtatgtggtatgtaaatatttttaaatgttgtctctctgttttgatcagtttttgttttattcaatttgtctttattaaatcttatcaaagc

SEQ ID NO: 6604 - DNA, 612 bp, Homo sapiens
ttctctatttttcagcctttgcaactggactgtgacctttgtgccatagtgtcaaactcaggtcagatggttggccagaaggtgggaaatgagatagatcgatcctcctgcatttggagaatgaacaatgcccccaccaaaggttatgaagaagatgtcggccgcatgaccatgattcgagttgtgtcccataccagcgttcctcttttgctaaaaaaccctgattattttttcaaggaagcgaatactactatttatgttatttggggacctttccgcaatatgaggaaagatggcaatggcatcgtttacaacatgttgaaaaagacagttggtatctatccgaatgcccaaatatacgtgaccacagagaagcgcatgagttactgtgatggagtttttaagaaggaaactgggaaggacaggacagaagggtatagaaaagtcccctaccattattatgaacaaggaagagatgagtgtgatgaatattttcttcatgaacatgccccatatgggggtcataggtttatcactgaaaagaaagtgtttgctaaatgggccaagaagcacaggataatatttacacatccaaactggacattgtcttga

SEQ ID NO: 6605 - DNA, 1691 bp, Homo sapiens
gcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagaggtgcccggctcccaccccttcccagccccagccctggagacagcagcccctagactactgagggacagcgacagcatgaaggctccgggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacagctactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagtcgccatgccgttgcgaggcctccgggatgtcccatcccaagccatcacactccacaaaaacatttaatttatggatcctgcctcctgccacgtgctgggtggacctaaggttccttcccgccccattctggcgacacttggagccatctcaggcctcatgacttgaaggggagtggaggggggagccgtgtctcccccctccactccctgagtaattcacggcatttgggggctcaccccacctccaggtctgtcaagtggcctttgtccctggggctgatggcccccaactcaccagcatcatgaccttgtgccagtcctggtcctccctccccagccgctcctaccaccttttggtgccacacttctcaggctggccgccctggttggggcagccgagagcctggggttcattggtgaaggggccttggagttgtgactgccggggccgtatcaggaacgtacgggtaaacgtgtgttttctgga

SEQ ID NO: 6606 - DNA, 1603 bp, Homo sapiens
gcgcggatcagcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagagggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacagctactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagtcgccatgccgttgcgaggcctccgggatgtcccatcccaagccatcacactccacaaaaacatttaatttatggatcctgcctcctgccacgtgctgggtggacctaaggttccttcccgccccattctggcgacacttggagccatctcaggcctcatgacttgaaggggagtggaggggggagccgtgtctcccccctccactccctgagtaattcacggcatttgggggctcaccccacctccaggtctgtcaagtggcctttgtccctggggctgatggcccccaactcaccagcatcatgaccttgtgccagtcctggtcctccctccccagccgctcctaccaccttttggtgccacacttctcaggctggccgccctggttggggcagccgagagcctggggttcattggtgaaggggccttggagttgtgactgccggggccgtatcaggaacgtacgggtaaacgtgtgttttctgg

SEQ ID NO: 6607 - DNA, 1013 bp, Homo sapiens
ggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagagggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacagctactgcagggagaagagccacccctcagtgccttaccactactttgagaagggccggctagatgagtgtcagatgtacctggcacacgagcaggcgccccgaagcgcccaccgcttcatcactgagaaggcggtcttctcccg

SEQ ID NO: 6608 - DNA, 1497 bp, Homo sapiens
agcttccagcccagtcggcccggcccgggggccatggagctccgagcggcggatcgcgagcctcctgcgaaccccagcctgcacgcccggttagcattcggccgggagatgcggcagtggaatctggaagggcggtgaaaaacctacgtcctgccctcgcccggcctctccattcgtcccccgggtagagagggtcggctcgtgctcatcatcctgtgctccgtggtcttctctgccgtctacatcctcctgtgctgctgggccggcctgcccctctgcctggccacctgcctggaccaccacttccccacaggctccaggcccactgtgccgggacccctgcacttcagtggatatagcagtgtgccagatgggaagccgctggtccgcgagccctgccgcagctgtgccgtggtgtccagctccggccaaatgctgggctcaggcctgggtgctgagatcgacagtgccgagtgcgtgttccgcatgaaccaggcgcccaccgtgggctttgaggcggatgtgggccagcgcagcaccctgcgtgtcgtctcacacacaagcgtgccgctgctgctgcgcaactattcacactacttccagaaggcccgagacacgctctacatggtgtggggccagggcaggcacatggaccgggtgctcggcggccgcacctaccgcacgctgctgcagctcaccaggatgtaccccggcctgcaggtgtacaccttcacggagcgcatgatggcctactgcgaccagatcttccaggacgagacgggcaagaaccggaggcagtcgggctccttcctcagcaccggctggttcaccatgatcctcgcgctggagctgtgtgaggagatcgtggtctatgggatggtcagcgacagctactgcagggagaagagccacccctcagtgccttaccactactttgagaagggccggctagatgagtgtcagatgtacctggcacacgagcaggcgccccgaagcgcccaccgcttcatcactgagaaggcggtcttctcccgctgggccaagaagaggcccatcgtgttcgcccatccgtcctggaggactgagtagcttccgtcgtcctgccagtcgccatgccgttgcgaggcctccgggatgtcccatcccaagccatcacactccactccctgagtaattcacggcatttgggggctcaccccacctccaggtctgtcaagtggcctttgtccctggggctgatggcccccaactcaccagcatcatgaccttgtgccagtcctggtcctccctccccagccgctcctaccaccttttggtgccacacttctcaggctggccgccctggttggggcagccgagagcctggggttcattggtgaaggggccttggagttgtgactgccggggccgtatcaggaacgtacgggtaaacgtgtgttttctggatgctgtctctagcgtggtcatgtgtctgatgtgtttaggggtggagatgag

SEQ ID NO: 6609 - DNA, 2310 bp, Homo sapiens
agatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 6610 - DNA, 2424 bp, Homo sapiens
ggctattcctggtggccgtgtaggagtaaacagcggctaggtcaaagggctcagagaatacaggaactgagaggcccctggagcaggggacggagctgaggagggccccctaagccccagtttcttccctctgcactcctgcccgccctgcccccggcctgtctgctggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 6611 - DNA, 2448 bp, Homo sapiens
gccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 6612 - DNA, 2406 bp, Homo sapiens
ctgggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccg

SEQ ID NO: 6613 - DNA, 2460 bp, Homo sapiens
gggccgggccgtgacggcggcgctaggacccggcgggccgcgggtgcggcgaggcctgggcggcctgaggagcgcggaccccggcgctcggctcccggcgccatgtgagggggctcgggggccgcggggggccgggcgctccccgccggagatgaggaaactgaggctcagagaggtcacatggcttgctcgaggccccccagccagtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgtctggaggcccggccagagaatttgtggggttgtggaggttgtgggggcggtggggaggtcccagaggtgggaggccggcatccaggtcttggctctgccctgagaccttggacaaacccttccccctctctgggcacccttctgcccacaccagtttccagtgcggagtctgagaccctttccacctcccctacaagtgccctcgggtctgtcctccccgtctggaccctcccagccactatcccttgctggaaggctcagctctttggggggtctggggtgacctccccacctcctggaaaactttagggtatttttgcgcaaactccttcagggttgggggactctgaaggaaacgggacaaaaccttaagctgttttcttagcccctcagccagctgccattagcttggctcttaaagggccaggcctccttttctgccctctagcagggaggttttccaactgttggaggcgcctttggggctgcccctttgtctggagtcactgggggcttccgagggtctccctcgaccctctgtcgtcctgggatggctgtcgggagctgtatcacctgggttctgtcccctggctctgtatcaggcactttattaaagctgggcctcagtggggtgtgtttgtctcctgctcttctggagcctggaaggaaagggcttcaggaggaggctgtgaggctggagggaccagatggaggaggccagcagctagccattgcacactggggtgatgggtgggggcggtgactgccccagacttggttttgtaatgatttgtacaggaataaacacacctacgctccgg

SEQ ID NO: 6614 - DNA, 802 bp, Homo sapiens
ccaggcagatggagatgatccttgacaggtctggtggctggttcggggtctactgaaggctgtcttgatcaggaaactgaagactctctgcttttgccacagcagttcctgcagcttccttgaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagacactgccctctcggtgccaccagtgtgtgattgtcagcagctccagccacctgctgggcaccaagctgggccctgagatcgagcgggctgagtgtacaatccgcatgaatgatgcacccaccactggctactcagctgatgtgggcaacaagaccacctaccgcgtcgtggcccattccagtgtgttccgcgtgctgaggaggccccaggagtttgtcaaccggacccctgaaaccgtgttcatcttctgggggcccccgagcaagatgcagaagccccagggcagcctcgtgcgtgtgatccagcgagcgggcctggtgttccccaacatggaagcatatgccgtctctcccggccgcatgcggcaatttgacgacctcttccggggtgagacgggcaaggacag

SEQ ID NO: 6615 - DNA, 1079 bp, Homo sapiens
agtttcttccctctgcactcctgcccgccctgcccccggcctgtctgctggaggtgtgaacccacatccctgcccccagggccacctgcaggacgccgacacctacccctcagcagacgccggagagaaatgagtagcaacaaagagcagcggtcagcagtgttcgtgatcctctttgccctcatcaccatcctcatcctctacagctccaacagtgccaatgaggtcttccattacggctccctgcggggccgtagccgccgacctgtcaacctcaagaagtggagcatcactgacggctatgtccccattctcggcaacaagggagaagtctcattcgtggttgagcacaggctggtttaccatggtgatcgcggtggagttgtgtgaccacgtgcatgtctatggcatggtcccccccaactactgcagccagcggccccgcctccagcgcatgccctaccactactacgagcccaaggggccggacgaatgtgtcacctacatccagaatgagcacagtcgcaagggcaaccaccaccgcttcatcaccgagaaaagggtcttctcatcgtgggcccagctgtatggcatcaccttctcccacccctcctggacctaggccacccagcctgtgggacctcaggagggtcagaggagaagcagcctccgcccagccgctaggccagggaccatcttctggccaatcaaggcttgctggagtgtctcccagccaatcagggccttgaggaggatgtatcctccagccaatcagggcctggggaatctgttggcgaatcagggatttgggagtctatgcggttaatcaggggtgtctttcttgtgcagtcagggtctgcgcacagtcaatcagggtagagggggtatttctgagtcaatctgaggctaaggacatgtcctttcccatgaggccttggttcagagccccaggaatggaccccccaatcactccccactctcctgggataatggggtcctgtcccaaggagctgggaacttggtgttgccccctcaatttccagcaccagaaagagagattgtgtgggggtagaagctgt

SEQ ID NO: 6616 - DNA, 6857 bp, Homo sapiens
ttccgccggggcaggcgccgggactccctcctggccgcccacagcctgtgcgcattcctgcattcctgccgccgcccgggacccgagtgccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccaaaacatatctccatggtacagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacccgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctagtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacgttcttttgtatttcaagataatttcacctgttgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtctagaa

SEQ ID NO: 6617 - DNA, 574 bp, Homo sapiens
ttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcattt

SEQ ID NO: 6618 - DNA, 1657 bp, Homo sapiens
cttccgccggggcaggcgccgggactccctcctggccgcccacagcctgtgcgcattcctgcattcctgccgccgcccgggacccgagtgccccggaggtgtccaggcgcggtgccaggcgggtactgtgcaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggctcatttgtaaaaattggccatatcagagcttgcagtgagccgagatcacgcgactgcactccagcctggacgacagagtgagactccatctcaaaaaaaaaaaaaaaactggccatataagaaacttaacattcatactgtttaaag

SEQ ID NO: 6619 - DNA, 7275 bp, Homo sapiens
gcagcctcggtgcgtgggccgggaaccgccgcctctccccggggctcggggccgcggttcctctggccgcgggagccgccgccgcgctgcccgaaacaatgaggcgtgcagcgcggggctgagcgtagcctcccgccggctttgaggccgagccacccgctgtgccccgccgcccgcgcttgcagctgccgccggcgcggagcagcgctggccccggagaggtgatcccgcaggccgcctgggacgggagcgcggggcagctccgagaccccacggtggcaggaggaggactcgagcctgcggcaggacgactcccgccgcgcactcgccttctgcagcccccaagttccgcggcgtgagtcggggaccccggccagggtcccagctctagcgggcgccagcgtgagtgtgggagcgcgtagcgcgcgcacccgagcggctgccggggaataaaatgtgacacgcacgccttggactccagtgccgcgctgccagggggagcaccgagcaccacggtgtcgtgcgcttcgaggcgcggcgtgggaagaaggctggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccccgctgagcctgtacccagctccctctccttcctggagaccaggaggctcctgccggtgcaggggaagcagcgggccatcatgggcgccgcacatgagccctccccgcctgggggcctggacgcacgccaggcgctgccccgcgcccacccagccggttcctttcatgcggggcctggagacctgcagaaatgggcccagtcccaagatgggtttgaacataaagagtttttttcatcccaggtggggagaaaatctcaaagtgctttctacccggaggatgacgactacttttttgctgctggtcagccagggtggcacagccacactcaggggacattgggattcccttcccccggggagccaggcccacgggagggggcttttccggctgcacaggtccagaggaggcgggtgaagaagaggcaccggaggcagagaaggagccacgtgttggaggagggcgacgacggcgacaggctgtactcctccatgtccagggccttcctgtaccggctctggaaggggaacgtctcttccaaaatgctgaacccgcgcctgcagaaggcgatgaaggattacctgaccgccaacaagcacggggtgcgcttccgcgggaagcgggaggccgggctgagcagggcacagctgctgtgccagctgcggagccgcgcgcgcgtgcggacgctggacggcaccgaggcgcccttttctgcgctgggctggcggcgcctggtgcccgccgtgcccctgagccagctgcacccccgcggcctgcgcagctgcgctgtcgtcatgtctgcaggcgcaatcctcaactcttccttgggcgaggaaatagattctcatgatgcggttttgagatttaactctgctcctacacgtggttatgagaaagatgttgggaataaaaccaccatacgcatcattaattcgcagattctgaccaaccccagccatcacttcattgacagttcactgtataaagacgtcattttggtggcctgggaccctgccccatattccgcaaatcttaacctgtggtacaaaaaaccggattacaacctgttcactccatatattcagcatcgtcagagaaacccaaatcagccattttacattcttcatcctaaatttatatggcagctctgggatattatccaggagaacactaaagagaagattcaaccaaacccaccatcttctggtttcattggaatcctcataatgatgtccatgtgcagagaggtgcacgtgtatgaatatatcccatccgtgcggcagacggagctgtgccactaccacgagctgtactacgacgcagcctgcaccctcggggcgtaccacccactactctatgagaagctcctggtgcagcgcctgaacatgggcacgcagggggatttgcatcgcaagggcaaggtggttcttcccggcttccaggcggtgcactgccctgcaccaagtccagtcattccacactcttaaaaagggtttcttgggaatcaatgtgcaataaggtactactgttgtactcaaagtcacaaaagaatacttgaagatagattttagacagtgtagttttgagtctttaaacagtaatttagtggtggtcatgataatccttctctttctaagccattgagtatgtattactgctttgaacatagaaatggtttttttaaaaaaataaggctcaagaaagatgcaaaaccaaggatagctagaaagaaaacacatgtatgaccatgggtatgatacctccagaaatgttaacaacttattcttctgccatgagtacccctcatcagggttggtttcaatgacaggttttggtgatgttcctgaccatatgaagtggtttatgtttagaaacattcaaattgagggacatcatttacagcatcgagtgtgtcagttatacatgcattcatcattaaatatcctaggttttatgacagacattgaaattatcactcagatgtgtttaacagcaaaaaattcccagcacatcctggcaaaggcttttatttccaaccgttgcattcttcatctctgcctcccattgcccactgaatgctttgctttctgtgcatcaagacagagttctaaaaccagaaaacatccatcttgaaaggtccaagaaaaagccaaattccatatagcaccacagaggaggccctttgtttccctgcagtatttcaaccaggaacattagtatcacatccaccaggaggcacatcactggcaagtaacatagaatcacagggctgcaggtgcccctggacactccccggttctggcttttctgccttgtacctcctcacctgcagatctaccctgcagcttttgcatagtcagtgacacacttgacaattggcacagctgtgctggggaagacgggagacaccttgctccttccaaactagaaggaaagattttggagccatcaccctgtgcttctagggatgcacgcctgtctttattatacaggtttcttgcaggtttttatcagccagtgggaactccacagtgatgagcactgaatcttcactaaatcttcctacagacatttaggaatccagtccttgcttttgcagatatgttttatgtcagcagcatgacaaagccatataattaaataatttatgtgaaagcattgcttattaacaaggaaaatatgtagatgcttcagagggaaaggcagctagagggaaattttcatcccaatatgttagctatattcagggttgattttttctttaatctcaactgtcactgatacattgaaaaatttttgctatgaatatagtgaaacagaaacattctgtaataccttaattaaacatgctattatttcaatgtataaccaaaacatatctccatggtacagttaagacttgttgcaatgacaatagcagcttaattaaatgcgttctcccttgcaaaatgtatgaatgtcaggagagtttagtggaaaagttttctttgtttcaggattggtttcttctagactgttctcaggactactttcttgagcaagaatggcttacagagactgaaggcttctgtttggttagtctattcagcagatatggagctggaaaacaagacatctcctatagcttgctataatagtgaaggagaaattggaaagttttaatcacaataatatccaataaaagcccattttgagagttttgttattaagtcaatgagaagggataggtaactttgtcctatatattaacttatgtctaaatagacatggttaagccatgttcctttctaatttcttttcttttcttttttttttttttttttgagacagtctctcgctctgtcgcccaggctagagtgcagtggtgcgatcttggttcactgccagctctgcctcccacgttcacaccattctcctgcctcagcctcctgagtagctggggactacaggcacccgccaccacgcccagctaattttttgtatttttagtagagacagggtttcaccgtgttagccagggtggtctcgatctcctgaccttgtgatctgcctgcctcggcctcccaaagtgatgggattataggcgtgagccaccaccgcgcccggtcattcctttctaatttcttgaaaaaactttgtcttgtccttatgtttacatgtgtgtaataatttcagcaactctggaatgtgggtgaggtggctgtggtggatgaatattactccctaccctccttggatctttctagatcttccagaccattaaatgcccctgaagctccttttatagttttgcaagtggatttacttgtagacatccttactatccagcataatcccccttggctgacatgagaacttggttagaggagaatttattggggtcagtgtaaatattcaagttcaaaagcctcagaacccaacactttaaagatttttaaatggaattttgtcgtagtcattgtacttttaaaatagtactttcagtttcattgaggttacaagaaagactgaagagtacaaaggaaatttagttacaatttttgcatttattatggccttaaagactcttgggaatcaggctctgttcaacagtcaataaatgtaatacacacattaatatagtactgactgggcgttcttctataaaagtttaagttctttggcttctaagaaaatgttgggcagttacagttaacttgatgactacttctagtattagccaaatgggtcctaagtggcagcattttgccagacattgactaaatccttacatgccacatttactgaattccaataaacatatagttcttctgtggagtagttaacagtaagtggcagctcactgaatttctcccaggttctgtctcttccaaaatcctccatcctctcttatgaagggaagctgataaaaaaaaatcctcttggtgcaagctgaagctgttaaggattccttttttcactctcaggaccaacagacgttcttttgtatttcaagataatttcacctgttgttgttgttgttgttgttgttgttgttgttgttgttgttgttacaaagaaacaaattttgagcagcaatgacaattcaaccatatctagattctccctaccttatttctccagccagtcacaccaggcagacgggtaacctttaacagacctggtgttctcatggaataccgatgctcgtcccagggagctgacctttctcactatgtccttatagagctgctcttacagagaactttgtgctcaggaccaagggatggtcaattaaaagttgcatgtaagcatcaggcttggatgggcaagggagggcttttatacatctttgaacgaccaggtctttccttgtctgcctgaaggcagagcttcgagaaacagcacttcccatgtgtctggtcctcttggtctctcagccagacacttaatcaatcctggactctccagtagtcctcagtcattgtagccatagcatctgcaaaaaaagaaatgctaaaataatcattagcgttttcaaaattaggaaatcaaagtagctgggtcactctcttacatgtgtatgagccagttaattctgctggacagatcatacttacgctgctgattgactcttctgagcagtaacacatctcctgaattaattaggtaggtcccgtttgggtgctttaagtgggatcagtcttagatgagtgccagtatgtgattgaatttcatacgcacaaatgccatgattcaagttctctctccagtttttcttatagatcaacacacagtacatgtggtcagttacttggttgaatttctgcttagctgtggtaagagacagagaaagggagtgaggtgggaccaggggaattatcagaaagacatgagtgaacctattggccaggtagcttccaagtatgttctattgtattgtctgttttgattctgatagtttagaactctttctgatagtttagaactcttacccagtggttacatgactgatcaaggcaactccatctggaaattaattgcttgggtaaaatgtccctgagtttcaacttgtcttttatctctggatattctcttatgagattattatgcatgtttctgtcacatgggcattatttacacacttgataaatgaaaggtatttctctgtccgttcaaggaaataaaatgtaagttcttgttttattaaatgaatgaagccttttggttaaaaaaaaagtaatgtaatatgtttctgttcaaacttgagctaatgacatttaaggaattaaagacattgatctagttcttagtatgaaaagtgtacatgtagatatagttatataattgtgtatatacatatctacacacatggttggttttatattgctttttcatcaatatttttgactgaaacctttacaataaattttattttaattatgtaaccactaatattttgagagaaggaagcaaatgttatatgtccttctgttaaaagaaaaaaaattcagtcctccgccaaccgcttcccacacactcatactctgcacatcttggctacattaaaatggactgacagaattatttaaaaggcactatgaaggtagaacactaccttaatattttatcctagtcagaagcctgatttaacactgaactttgaagggaagcttagctgtagctcatggctttcaaagattagaagaaacatttactggttctatggaaaatagtcttcttgctaggtagattggaaacaaagaaattgcattggtggtgttaaaatctaacatttataacaaatcctgttttattctagatgaaatacttagacaattcttccagtggaaaccagtgaacttttttaacagctttgggaattcttttgtatgataatttttaaaatgaaatgtgtactcttcaaactaattaaagcttgaagttttccaggagtcgcattttaaaagtgtttgtacacattttaacacttggatattttctattttggttttgtatatttttatgtatacacaatgtacagacttttttcttgtaaataaaacatgttttcatttgtct

SEQ ID NO: 6620 - DNA, 308 bp, Homo sapiens
acactccgtgtttaggagcgagacccgtgtgtggggaatgttgaaggtggtttggggaaaagcaggaaattctggagaagcgaacgggaggacggcttgcgctttggggacgggcggatacagttgtgcccctgtggctcagtaaaggttcattctgccacccatctgcattaagacacaaggtgctgaccgcagagacctgccatgaaaccacacttgaagcaatggagacaacgaatgcttttcggaatattcgcttgggggctcctctttttgctgattttcatctacttcaccgacagcaaccc

SEQ ID NO: 6621 - DNA, 2106 bp, Homo sapiens
ggggggggttgcctggcggcgcagcagcgcgggaggcggcgaagggcgcaggagcatcgctcggaggggacaaggggacgccacgggccacatgtttaggagggagccgagccttctcccggaccctcgccgagggcgaccgtgatgctgcagaaccggcgggagcgactcgccgccgccgctctctgcgcactcggagaccccagcgcccgccttctgcaggggaagcgaccatggccatagatcgtgacttcacccccagccacttcccctagaaagaaatccttggaaaagttgcatttgaaaaaatccttgcgctgacctttggggccgacggggccgaagaagcgtgcgtgcgtttgcaagtaagagaaccaaaggtgtgtgtgcatggggggctggcggtgggggaccctccgctgccacttcgcctagctttgtgctgaggccccggcccccgcccctgggacgccggggctgcgatgagcccctgcgggcgggcccggcgacaaacgtccagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacaggcaaccccattccagctgccattgaagaaatgcgcggtggtgggaaatggtgggattctgaagaagagtggctgtggccgtcaaatagatgaagcaaattttgtcatgcgatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataagaacctgtcttattaagactggctttagaaccgtaggtttttttaaaaaattattatttatttttgccctctttggggaagtgggtgggtagatttaaaaaatcccttcctgagtaataaagatacaaaatgttactgctgataa

SEQ ID NO: 6622 - DNA, 1336 bp, Homo sapiens
cagaggggccatggctgtactggcgtggaagttcccgcggacccggctgcccatgggagccagtgccctctgtgtcgtggtcctctgttggctctacatcttccccgtctaccggctgcccaacgagaaagagatcgtgcagggggtgctgcaacagggcacggcgtggaggaggaaccagaccgcggccagagcgttcaggaaacaaatggaagactgctgcgaccctgcccatctctttgctatgactaaaatgaattcccctatggggaagagcatgtggtatgacggggagtttttatactcattcaccattgacaattcaacttactctctcttcccacagatgcaatctccctcctttgtcaagtgaatacactaaggatgttggatccaaaagtcagttagtgacagctaatcccagcataattcggcaaaggtttcagaaccttctgtggtccagaaagacatttgtggacaacatgaaaatttataaccacagttacatctacatgcctgccttttctatgaagacaggaacagagccatctttgagggtttattatacactgtcagatgttggtgccaatcaaacagtgctgtttgccaaccccaactttctgcgtagcattggaaagttctggaaaagtagaggaatccatgccaagcgcctgtccacaggactttttctggtgagcgcagctctgggtctctgtgaagaggtggccatctatggcttctggcccttctctgtgaatatgcatgagcagcccatcagccaccactactatgacaacgtcttacccttttctggcttccatgccatgcccgaggaatttctccaactctggtatcttcataaaatcggtgcactgagaatgcagctggacccatgtgaagatacctcactccagcccacttcctaggaacaatggaagaagaaaggactgaaccagggtatttttgttaggttttctatgtgactccaagagggaatggtcaagttgtttcatgagtttgcatgggcccttggaaaaacaggaaaggagcaatgaagatccaagcaaaactttactttcagcgttggcttggaggacaaataagaaatgaaacatcctatgaaatactttatagcacatggcagatttgcaactagtaaaatgctggtgaaatgctgttggtaaagcacatggttcaaatctagaagatgcagttcaaaaacaagacagactcgagttgttagggctgaggaaccaatcaaggtagaacaaagaaaatgttggggtaaaagtgttgctgattgtcaacacaaactggcttaataatattaataaga

SEQ ID NO: 6623 - DNA, 5708 bp, Homo sapiens
gggagggaggggcaggcgggagccgggagggagcgagcgggctcgccgcgcctgagcaacccctgcctgtcgctgccgctgccgctgccgctgccgccgccggcccggactcgtccggagcgcagggtgtctgcccagctgcgcgcggcgcgcggaggctccggcgtccgccgctgcgccctccggcccctgctcctcgcgccggcccgcgtgggtcccggcgggcgcgaacccaccatgcagctgcagttccggagctggatgctggccgcgctcacgctgctcgtggtcttcctcatcttcgcagacatctcagagatcgaagaagaaatcgggaattcgggaggcagaggtacaatcagatcagctgtgaacagcttacatagcaaatctaatagagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtagggtgggcaccccatgggactcagtggctcacatttcctgccagctacaccacaggcagatgggagtcggggtggcacaaacaatagaacaagcaggctagtggttttctttgttaaagtgtaaaacagtgaccagaatatatatatctatacctgcatatatatattgacctgagtatttataactgtgtggtgttcatctagcattaggcagataggccacaggaagaaggtgtggagaacccacctgaaccagattgagactcaatccatctttgggggtggaaggacttgacatgaaaagaagccagtcccatgactttggatgacaaactgcctcctggcttggagggatctttgggctcatggatgaatggcgagccacctgttgtcagctgccccaagcctctgggatatgtggattcggagaaagctgaggcccagaggggacactcgacccagtctaaagtgggtgccattcacggaggagagggaggttggagacttcaaccgggcaaaggagcacaaggaaaccaagcagcagaggccccatcagcacagagggcctcgttccacgaacgtagagtttgactgcctaagggacagcacgaatgactcacatgtttcagacaggcctccacggctatggagagaaggctggaggagacacaatggatggttcatgttctggcttagcaagagccaccaagaactttgggtgaagcaagcagatgacaatgaagaggagtaatgttccgaatcatgtttttgaaaaatcaagacctcctgttaagggcccacttgaccctagaataaggcaggagagtgtctaaaatctagctgctttgggtgttttttaaagcaatgtgagtccactgaggaggaagagaccctgggatttcaccctctgggttagtctctgtctcaccctgttagaatgtcacgagggactgtactgtcccctctgtcaccagggaagccacaatgagagcttgaaagggtgctgtcaagataaatgtcatccttcttaaaatacatatgattgcctttttgggtgcctcacagagccccagagtgtgagacctgaaagaatgttcagcatctagctccatgtccctgcaaccactctctgtttgccttctgcattctgcactctgcggggcctttgcagccagactgctgtgtcaatgttactttcttgtcactttcctaccctgatggtcacactagcccaccccaagctccgacattgaggttttcatctctgcagggagaggttccaatgtccaccccacccccaggtacccgcctcttcccacagaagcaattttagaattttgcaaaattcttttccccttattgagattaatatttaagattaaaaaaaaaatacccaaagccaaatgcagttccaaatagtggacataatctcccagggaaatctgggctcgaggcctacaacttaggggctggaatcacaggtctcacatagagaaatagccagcttgaatttgttagtcgtattccttcacctgatgaataacagtgttttaaaacatatttgaaaggtaagtaaaaaactaccatcttgaaggtgaagggagttaagaaaagtaatcaagacctgctcctaagcatatgagaccagatgtaattaatcaatggcaatgcagaacaggaccttggctctaaattaatggttgaccggaagggattggaggcggcagaaccattaaccctacacaagaacactccagcccaaaaccgtgaggaaggtgatatatctctgcattttcccttgttgttgcttgaagtctgtgattggggatttgcgttataaaatgaatattttaaaaagcaacagccctaatagcctctgtgggaactgagtggtttcggactcctcacaggcggtggaaataattaataccatattttatacatctccagagcctttcatcttgaggatctcaaagaccgtagaagacatttaatttctaaagcttgaagtgccccgaggagcaggtagaatttccagcagggccttggtggattaaccaaggccttggattccagaatgtttcatggtaagcactgtggagaacctacatgtcaggttctggagttggccctgagctctatccaccaagccagcaccccaccatccctttgcaggggagtcaaagggccagaactccttgggggaccagaacatggttttccttctgcctatcttagtcatggctcctaaaattgaagctgatatgagctggagtgcaaggagtccttccaccctgccttcaggttctctctggagaaaggttagagaccccaggacaatcaacatgtgcaccgttcccctcctcggcttgagtcctgcactaccaaaatggcctggccatttgatggcggagctccaggggccttggctttctctggctcattgtccttctccatctgggccaattgtccttccctgcccattcagagttcaatttgagcctccactgcagttcctggtgtgggccagctggtgttgggtggccccagggagtcacacagtctgtacccggccccgagatcctctgctgtaactgcagggtcacaggcatcccgggagaatgggcctccaccctcagccagccctcactgctgacaggcacccctctgtcacctcctgccacctgtcagatacccagcctgcccgccatcagccacccgagtggttccgacctccattcacctcaagccccaacaggcccctgtcattccacttcatggaagagacggagccttctgaaatgagatctaccctgaaaatctcttctccttcccctttctgagaaacgtcatccccaccagttaacgtttcctgtacaccctcaccctctctcgtccatctctgttgcctctgcacatcagcacacactgactccacctgggctggctcctgccgcctcttccctacctcctccactagccgcaggaagggcctccagcacccacaactgcccttcctcttgatgcccctcggcttccccccagcctggcagcagcgtcccagcgcctccacattgcccctctcacctcccagctctccacgccacttggctctgcagcgacccctcctagacgctccctggcccctcggcacccagaatgccacattcttgtgtttttttcctccttctttcccaatccctctcaaccatgtatttatttatatatgtatgtatttttttatttattatttatttattgaaacccctactttgattgacaaaggaatcaaggtagatctgaccagtattcccctctcttctccttgtcccaccacatggacatgccttacactggcgtcctctcctgagtccctccgcactctccatcagcaacctcacacctgccttcagacccggctgcaacttcctaagctgcccctgccccagctcctctctgcaacccagccctctcctgagctctaggctgggattacacccgctggagggacactcaccccatctgctcccacggcagcaccatcaactcaacaagtcagaagccaagtggatcatctgtgtccccttcccccacaatccctcctttttctagtaaaagacccgtgatcccgtcagccacccagtctgagatgctgacgttatcttcgactattcttccctgtcctgccttgctaattcttcccactagcactaatctcgactctttgtcacttggactatttcagcaacagtctcatctcccagattacctctgtgcacactgacacgtggtcccgtccatcctgaacatgcacagtgattttcctctcccgttgcacacaaacctttaaaagttccccggcccgtgaacaaatgtacaattctctattctgacattacagaccaccggataaggccccattcttcctttacaccctcccctggtcagcctaggagagttgtttttcctggaaagggtgcctgcgttttactgtctctgtgcctttggtcttgctatccccatcccctggaatgctcccttttcttcccttcaaagcccatgcggaaaccacgtccttcatgaagccctccctgatgtaccaaccactgggatctctccctctgctgaaccaccgtagcactttatttgtacctttctcatggcacttaccatattctgccttgtattatagttatttgtgcacttgtcctttgactgttcttagactgtaagcttgccaagggcagggactgtgttttattcatctgtatccatcacagcactaggcgtggtgcatagcacacagcagttgctcaataaatgtttgttggattaaatccttaa

SEQ ID NO: 6624 - DNA, 1089 bp, Homo sapiens
ggtcccggcgggcgcgaacccaccatgcagctgcagttccggagctggatgctggccgcgctcacgctgctcgtggtcttcctcatcttcgcagacatctcagagatcgaagaagaaatcggagctgaagttgtaataaacggctcctcatcaccagctgttgttgacagaagtaatgaaagcatcaagcacaacatccagccagcctcgtccaaatggagacataaccagacgctctctctgaggatcaggaagcagattttaaagttcttggatgctgaaaaggacatttctgtcctaaagggaaccctgaagcctggagatattattcattacatcttcgatcgagacagcaccatgaatgtgtcccagaacctctacgagctcctccccaggacttcgccactgaagaataagcactttgggacttgtgccatcgtgggcaactcgggggtcttgctgaacagcggctgtgggcaggagattgacgcccacagcttcgtcatcaggtgcaacctggccccagtacaggagtatgcccgggatgtggggctcaagacagacctggtaaccatgaacccctcggtcatccagcgggcctttgaggacttggtcaatgccacgtggcgggagaagctgctgcaacggctgcacagcctcaatggcagcatcctgtggatccctgccttcatggcccggggcggcaaggagcgtgttgagtgggtcaacgagcttatcctgaagcaccacgtcaacgtgcgcactgcatacccctcgctgcgcctgctgcacgccgttcgcggatactggctgaccaacaaagtccacatcaaaagacccaccaccggcctcttgatgtataccctggccacacgtttctgcaaacaaatctacctctacggcttctggccctttccgctggatcagaaccagaacccagtcaagtaccactattatgacagcctcaagtatggctacacctcccaggccagcccgcataccatgcccttggagtttaaggccctcaagagcctacatgagcagggggctttgaaactgactgtcggccagtgcgatggggccacgtag

SEQ ID NO: 6625 - DNA, 10154 bp, Homo sapiens
ggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctccccccacccccgcccgggtccccctcctccgccacacgcgcgcgcgctcacacacacacacacacacacacacacacacacacacatatatacacgccagcgagctgctggccgctcaatggaccgatttccccggtttccctgaacccagcccagcccgggatgagaaactgcaaaatggcccgggtcgccagtgtgctggggctggtcatgctcagcgtcgccctgctgattttatcgctcatcagctacgtgtccctgaaaaaggagaacatcttcaccactcccaagtacgccagcccgggggcgccccgaatgtacatgttccacgcgggattccggtcacaatttgcgctgaagtttctagacccgtcattcgtgcccattacgaattctctcacccaggaactccaagagaaaccttctaagtggaaatttaatcggacagcgtttttacatcaaaggcaagaaattcttcagcatgtcgatgtaataaaaaatttttctttgaccaagaatagtgttcggattggacaactgatgcactatgattattccagccataaatatgttttctctattagcaataacttccggtcacttcttccagatgtgtcacccattatgaacaagcattataatatttgtgctgtggttggaaatagtgggatcctgacagggagccagtgtggacaagaaatagataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggtactggaaaaacaaacatttgtcacctaaacggctgagcacaggtattcttatgtacacccttgcatcagcaatatgtgaagagatccacttgtatggattttggccgtttggatttgaccccaacacaagggaagatcttccataccattactatgacaaaaaaggaaccaaatttaccaccaagtggcaggagtcccaccagctgcctgctgagtttcagctgctgtaccgaatgcatggggaagggctcaccaagctgactctgtcacactgtgcctaagaactccaaacggaaagcgccaaatggctgtttaaaaagtgccccaaatcaaattgaatagccttcagaatagaaccctagagaatgtcttataaggattgtctgccatttaaaaggaaagatgtcttttctcttttgcactgctcttttaagagttttagcagatttagcaggacagatgcattgaagccacatggtttagacttgattgataaagggaatgttgcatttgggactatgctgctaacgaaatggtttgaagtattttcatgtttggattttaataataaactgcctctcatttttatgaggactagagctatagtttctgcagctctgctcagatagtcctcataatcagaggcctctggccaactggggcaggacctgttttgctggtgggatcagactctgaaaaatggaaacgtaaaaaactggtttgcatatctcatcttctatctatctccctatctccatctctatcaccatctcactccttccctctgcaactactccctgccctaccaccgtggagtttaataatttgctaggaatcctattgaattcgctttgcttgtatatgttgcatttgtacttgatgtgtttaaggttctgggtaactttgatgcttcatgacaaaataggcaaatcacgatggactcccttgtgattccttttttaaagaaatgcctctgatgcagtcctcaccagtccattcagtcattctacagcaagatggtccctctgtggtgagtgggatataaggcagtgcatctttcatgatcacaaagaaagcctatgttgtggatagcattgcgtctcttgatgtaggcattgttatggcaaataatagcactgtggccacatctgtaaggccattccagcctaaatttagtgtctcccataatcccaacccatgcactaggctgggtgttctctcagaatatagaggcaatgaatcagcttaagaccctgggacacacaaaggaaaaggaagaagaatatttagaagttgttatggaatcctgtgtaccctaaagtgtggtaaccatgttacccattccagctgggttaaagtggaggaggatcttggccaggccaggtgcccaggtgactagtgctgaggtgcgatcgttttccgtatcattgtgtgcaccaccaccaatccagaaccatttgctctctttgagaacattgtagcactggatattccctctttccactgaagtcagatctatacaactacaaattaagcatttcaaaagaaaaagccattgtgcagtggcaagagttggaatccaagattatgtagacctgcgatgaaggaagtagctggccattctcattttctttatttcagccatatgagtagaaatcaaatcattcccatccctggctttttactgagcagcactttgttcttccaattcagcccaacgtctggccaagttgatgttaaattttaataagagtttctttcttctttccaaatgccagtcaagcatatttgttatgcatttgagtggggtagctcattcttttcctgaaatctcatctagattgcttgcaatgcgacaaataactgtttaaaaaatgtgctgtagttcagtgatgagctcattgcccctctttaggaaggtaagatcatgcctaaaattaaaccgaatatggtaaggaaagacactatcgttatgctcacgttctgcctggtcctaaacctgccttattattattttcagaaagcaatctaattagagcaacttgcatagatctagatattaactaatgaaagaaacaccaagttcaaatgtgttaccaattatgacacacattacaatataattataaggggagacattaaaaacattttgtaattcagtggtataatttgatgggtatcacaaccacaccgtgtttgttccctgtccctttgaagaggactgtactaccatcctcacactgtgctctgttgggatcactgagagattgacaactgacagaagtgtttagttggctgttcctgagcacttagttcatttggttatagctaagtgatattaatgccaatattacttgggccagattctgactctggagttttaatcccaatgtgcccattcattttcactaaatataaatgcatagacactttaaaccaagaagattaaaagaggaaaagaccagaatctctaaaaaacagtttactgttctgtagtggacaatttaaattttatctcatcataatgccaaggatttttgtttgttttttaagttcagggagattttttaaatctccttgcagtcttggctccatcttaaccttagagtgggaggactttcccatcccccaccaccgtgttatctatcactttaatgaaaactcaaaatagtgaggaaatggacttttcttcagaacttgaggggtttagagatcaggctcatctctgcttataaggaggacttcctggagatgatcccaatagatcacccttcacttttgaagaatagcagcttctagctgaccatgcaaaatctctgtttgtttttaaagactgtttcaaagattaaatctatacaaccacttttatgaccaaaaaagttgttgtgtcccaagtgtcctaattagaaaggcagctggctctcctgcagctcccaggcttgtgtagtcaagtgcagtgaactgggcagtaatcagctcaggaccattggctctttcctcctctttcagctacagacacatgccctggcttttgcattgaccttgctttgttagttctagactaatttatccttttgtcagacactttcccttttttaggatactcacaacagagtccactttcagctattggaatacattttaccataaagcccccaaggctttctacccataacaccaacacaaaaaaccaattaagttgcagaggggggaaataatcacaaacttttggcaacctgcttaatgctagacgctctgttttcactggttattctgagtgtcatatgcagatgcagatccaagggagacagggctaaatggtggtgtcaagaattcctcccacaccccaaaaattctttccaatatttgattattaaaatatctatcatttctccaccttgtgtctgtgtcttaagtgtctgtgaatattgtaaaagtgctgtatgtttagtagtgttgtgtgcctggcagtgctgactatgactactgtgccatctgtctgtgaccttgatgtcaggtacctggccatggggctaccagcaaggatgtgcaaaggaagaaccgctgcccctgccctcagcttccttatgcccgagccactacttatccgtgaatgtgagtgccaagagaaacctaatttggtggggaagccaaggaatgggagaacgttttttctgatttgagtcaaggcactaattattagacactctcagacaacaaagcggtattgacctgagatcaaaggaagcagggacaatattgtagaatgctaggacactggaaatgaagaggccttcagcttcgccagtcttgattcttgactttacaaatgagaaaatggagaaacagggaggctaggtgatttgccccagatgacactgtcaattagtggagaaattatgattcctcctctagtacttcttggtcttaccagcatcaaatgaagctgggctcacagggaaagtggtttttggtctgggatctgcagagcacataaaataagttagaaagtctataaaagaggaaaaaaggttctcctctccctcccaaaaatgacttcccaacacagaacaataaaggagatgcttgtgtgggtatgcaactgtccaccaattatcacctaccttctccctgagatgaaacaaaacacgcttggtaaatcatgatttgataaataacaattaagttactggtggttcatgcttgacagctgcaatcttacccaataagctattcatcttagtaaaaccttgttttagtaatatacatgcataatttagaagttgaaggctgaaaattgttgtgttcttctccatatatatacaactttcatcggggtcccttgagttaagaaatgccttctattttataggtaatctcaacagcagactttgaaatattgtgtttggttcaatatgctaagaagatatacaaataataataacttcgtgagtcttcatgtgcaaaatgacaaactgagcaattttctgtataattctagattcttaaaaccttttttcccataattgtttgaatgcactaggcacaagtttctgtttaagcctctgcttctccctgaatgtgtagaactgtcactttgcttacaaaggggctgtgtgtttgtggctggcagcccagatagagcactctgggtgctggggattgagggcaccttggccagctgattgacctgtctggactctgtggcccaattaatcgaggccacagatcagttggtactaagcatcaaaatgattcattatgcctctctcacactccgattgctttgccacatagataacagcatttgaaatgggaaacactttagaatgtcattattgtattatatattgtcatcttatgcagtatttctgaaaatttatttttattgtgatgactgattgaagacatatgtgtatgaatagatgttcctcagtgaagcctattctcttgttgttgatgacagtggcatcagagtgaagagttgttgcagagtaactgacttcagtttaaggttaccctggggttctggggttaggacccggattatgcagctgatctcccagcaaacacagctgtatgaaataagcaactcttcaaaatacaattcttgccactcattctggacctttgattcataatgtcctgggataagtccaacttacaaagattcccaggtgattcgtgtgaccaccatttggaaaccagtaatatatacatccggagtcatatataccattttgaacaaagtagctaaatgcttatctctccttgtgcgattagtttcacatgttcgttgaggttatcatgttaaatggcaatatagacacagtcttagtgattcaacaattcagctgtttcagccgaattgaccagttgctaatttataagcaaattgtaactgatcaatttagtcagaatggatgcaagcccaaagacaaggtggagagcaagctttaatatacactttgtctcaaggccagctcttcatatttccctctttatatttcaaactaagaggcagatctcaggtcactcatctttagaattggtgagaatgagaaacagggaactgaagtgattcattcagattcaatttggaagtcattcccagagcctaaaatatttatctaaggggtctgatttatcaacctcaggtagtctccaaaacacaaaggtattcaggctaaaataaaaccaatcaaaaaaggaaattcaggaggctccagttctaagactaacccagtataacaagggtgatcagttattacttgtggccttgtaccacctctgttggataatgtgccaccgtcctaatgaagctttggccagacttctttctatagctgtgcacatagaaaggctttagacaacagtgataccaaagggttcctttgattttccttctgtgtgattctcagacagttttagctctttggtgtgctgccaaatgtttaacaactggctctggaaaacagtggaacccagatttttagcacctaccaatttctatggtgtaaatactctcatctcagccaatttcaggctactaacttaatgtcaaccagctgaaaacacaacaatatgttttcaagagccagtataagttggctccaatacagcatgagccagctccagcatagcactgcctgaacaatttttaagtcagtgagtaccaaataggagaggctagcagaggctttggagggacttttaaatgtcccctccaccaagggaagcatttccatgttggttagttttactgatttttagtaaaagagcatattattggatcccaaggtgttcaaatattccacgtgactcttaggaacctctcaacagactccccagtatcttgggagattaccaactgtggcttttctaatttctaagggtgaccctccaggaaaacattctttaatttaactaccagttaaaaccatgtttggctgatcttttttaaaaaatctatacctatagttcatcacttgtttccccaactttgtcattttccctatccacttgcccctcatccttctgacacaataaaaaaaatacaggtacccacaaaacagtgcctgcaaaggagcaggggaagaacaaggcacccagtaagctcacttggctctacatatctggaaaggcactgaggttccaaggtctctaccccaccaggggacacccagtaaacatcacgctgagagtttaagttgcactcaactggagttgatttgcccttagaaaagtttccaacggtgaagaaataccacttggtaggaatatctctgggcaacttcattgctgactgggcaaactttgtaggataaggtgtcatgtgatgtaaggctggaccatgaaaaacaaaaatctactaatacacatttggcccctgcagtcccctggcattgagcaatagagcaactgtcctttctcaccactagttgtgagtgtacttccaactgagtgtttagaaatcaggtaatctggtaatccacagaacaagctttgtttgcaaattgcaaatttttctggtagaagtcattcttaggtgggcttcattaaatctttggagaggcaatgctgggaaaaaatatgcctaattcctaggacacagtgagtggccgtaagttgttatctgcatgtactaaatcaaaattagatcatgaaggaccaaatctacttccgttgctataataaaataccctacaggttctgtaaggcatttctaaactgtaaatgcttgaaacgcaagttggacattttctatactatgtgtaaaatgccaggttatacctctattttctttcttcctaatggtcattgaaatgagcttgtttctctacattgagcaagctacattttattttaaatgagtcaggtgcatgttcagatgtctgtattcccaatacattgcatgcagcctgagcacaagtatgccttcaccctctggctcttttcctgacaccaaacagagaagtccacagctacaagcacaaggggcttgacaggtaggccttgttttattatgaacaaattcaccagaaaaccattcttgaggaaccagccactcccatagcatttttagtcttagggaagaaaattggcagggaagaaaaattggcagacaatgggaaagaggtttggtcaacctgcataagtggaataaagtcattgaagtacttgcaaaaagaagagggaggtttccctctgaaggaatctagaccattttttaatatggagaataactgtaccccatgttagaagtgctctttagccatatttcaagatccagatctgaacccatactgtgcagaaaagcacaagagcgcttacagccaagagccctgggaggagttgagtaacaggctgagatccggtcaccaagcatcattagttagcactgaaattctcccaggacacaaaacaaatgtatggaaacatcgcaatacactatcatttactcacatgggacaaccacctaagtccatagcaaaactttacagatctagatgttatctcaagtcaggattccagatcaacatcctccatgtggagatgagacaactgaggttcagaaagttggagtgacttatttgcccagctagctaactggaattagagtctgggtctcccaaccactgattctgctacaccacactgtgctgcttccattagttagatggacattgacaattaattgtgaaagcattaattagaagtcaagacaaaagaatgtttgtgatatcttctctcgcttaacatactttgatttcaccattgcatttcagcattttaaagaatagtgtatcagtatagaaggaggagcaaagctctttaagagtaatgatgaaaccaaaaggtcaaaaagtagaagaatagcgaatgtaagttattaaataaatgagcaagaagtatgtgtcagggaaaataaatgcttcttatattgttaataccgtgattccctgcccgctcaccccgtcactcaacacttgatgcatttgttttggaaagtgccattttatgctgagatactggtattgaaaacttccctctttcccaactctgtcagaagttctcttgctctttggaagaagccgagggccttaacaaatcagactgacctcccttgtgacaggcagcctcgcctgcccttggaaacaagctgccagaatgtgagggccacagagacccaagagaagccagcactgctagactgaggaacttgtaaatatcttctgctttcttggtgaacaaggacagaggcaattgcgtgtatattgtgactgtagtttgtgaagaaaatgcaaccatttgcttcgacagctcctcaaatgtacttgttaagtgtgaatgtgcctgcctcattgccttgtgttccaaacacagtactgaatgcgttgtttttaaataaaccatttcgttttgctttgggaaa

SEQ ID NO: 6626 - DNA, 10152 bp, Homo sapiens
ggcagcctcgctggaaacgcgcgggggagcctgagccggcggccggggacgcacggcgctgcgcgctccttcgccacgccgccgcgcagcccctccatcttcctgctcggcaccgggccccgcgcgcccctgcctacggggtcccgctgctctccggggctcctgccagccccaacccccggccccggtggcctccccccacccccgcccgggtccccctcctccgccacacgcgcgcgcgcacacacacacacacacacacacacacacacacacacatatatacacgccagcgagctgctggccgctcaatggaccgatttccccggtttccctgaacccagcccagcccgggatgagaaactgcaaaatggcccgggtcgccagtgtgctggggctggtcatgctcagcgtcgccctgctgattttatcgctcatcagctacgtgtccctgaaaaaggagaacatcttcaccactcccaagtacgccagcccgggggcgccccgaatgtacatgttccacgcgggattccggtcacaatttgcgctgaagtttctagacccgtcattcgtgcccattacgaattctctcacccaggaactccaagagaaaccttctaagtggaaatttaatcggacagcgtttttacatcaaaggcaagaaattcttcagcatgtcgatgtaataaaaaatttttctttgaccaagaatagtgttcggattggacaactgatgcactatgattattccagccataaatatgttttctctattagcaataacttccggtcacttcttccagatgtgtcacccattatgaacaagcattataatatttgtgctgtggttggaaatagtgggatcctgacagggagccagtgtggacaagaaatagataaatcagattttgttttccgttgcaatttcgcccctacggaggctttccaaagagatgttggaagaaaaaccaatcttaccaccttcaaccccagcatcctggaaaaatattacaacaatctcttgactattcaggaccgtaacaactttttcctcagtttaaaaaagcttgacggggccattctttggatccctgcatttttcttccacacttcagcaactgtgaccaggacattagttgacttttttgttgaacacagaggtcagttaaaagtccaactggcttggccgggaaatataatgcaacatgtcaacaggtactggaaaaacaaacatttgtcacctaaacggctgagcacaggtattcttatgtacacccttgcatcagcaatatgtgaagagatccacttgtatggattttggccgtttggatttgaccccaacacaagggaagatcttccataccattactatgacaaaaaaggaaccaaatttaccaccaagtggcaggagtcccaccagctgcctgctgagtttcagctgctgtaccgaatgcatggggaagggctcaccaagctgactctgtcacactgtgcctaagaactccaaacggaaagcgccaaatggctgtttaaaaagtgccccaaatcaaattgaatagccttcagaatagaaccctagagaatgtcttataaggattgtctgccatttaaaaggaaagatgtcttttctcttttgcactgctcttttaagagttttagcagatttagcaggacagatgcattgaagccacatggtttagacttgattgataaagggaatgttgcatttgggactatgctgctaacgaaatggtttgaagtattttcatgtttggattttaataataaactgcctctcatttttatgaggactagagctatagtttctgcagctctgctcagatagtcctcataatcagaggcctctggccaactggggcaggacctgttttgctggtgggatcagactctgaaaaatggaaacgtaaaaaactggtttgcatatctcatcttctatctatctccctatctccatctctatcaccatctcactccttccctctgcaactactccctgccctaccaccgtggagtttaataatttgctaggaatcctattgaattcgctttgcttgtatatgttgcatttgtacttgatgtgtttaaggttctgggtaactttgatgcttcatgacaaaataggcaaatcacgatggactcccttgtgattccttttttaaagaaatgcctctgatgcagtcctcaccagtccattcagtcattctacagcaagatggtccctctgtggtgagtgggatataaggcagtgcatctttcatgatcacaaagaaagcctatgttgtggatagcattgcgtctcttgatgtaggcattgttatggcaaataatagcactgtggccacatctgtaaggccattccagcctaaatttagtgtctcccataatcccaacccatgcactaggctgggtgttctctcagaatatagaggcaatgaatcagcttaagaccctgggacacacaaaggaaaaggaagaagaatatttagaagttgttatggaatcctgtgtaccctaaagtgtggtaaccatgttacccattccagctgggttaaagtggaggaggatcttggccaggccaggtgcccaggtgactagtgctgaggtgcgatcgttttccgtatcattgtgtgcaccaccaccaatccagaaccatttgctctctttgagaacattgtagcactggatattccctctttccactgaagtcagatctatacaactacaaattaagcatttcaaaagaaaaagccattgtgcagtggcaagagttggaatccaagattatgtagacctgcgatgaaggaagtagctggccattctcattttctttatttcagccatatgagtagaaatcaaatcattcccatccctggctttttactgagcagcactttgttcttccaattcagcccaacgtctggccaagttgatgttaaattttaataagagtttctttcttctttccaaatgccagtcaagcatatttgttatgcatttgagtggggtagctcattcttttcctgaaatctcatctagattgcttgcaatgcgacaaataactgtttaaaaaatgtgctgtagttcagtgatgagctcattgcccctctttaggaaggtaagatcatgcctaaaattaaaccgaatatggtaaggaaagacactatcgttatgctcacgttctgcctggtcctaaacctgccttattattattttcagaaagcaatctaattagagcaacttgcatagatctagatattaactaatgaaagaaacaccaagttcaaatgtgttaccaattatgacacacattacaatataattataaggggagacattaaaaacattttgtaattcagtggtataatttgatgggtatcacaaccacaccgtgtttgttccctgtccctttgaagaggactgtactaccatcctcacactgtgctctgttgggatcactgagagattgacaactgacagaagtgtttagttggctgttcctgagcacttagttcatttggttatagctaagtgatattaatgccaatattacttgggccagattctgactctggagttttaatcccaatgtgcccattcattttcactaaatataaatgcatagacactttaaaccaagaagattaaaagaggaaaagaccagaatctctaaaaaacagtttactgttctgtagtggacaatttaaattttatctcatcataatgccaaggatttttgtttgttttttaagttcagggagattttttaaatctccttgcagtcttggctccatcttaaccttagagtgggaggactttcccatcccccaccaccgtgttatctatcactttaatgaaaactcaaaatagtgaggaaatggacttttcttcagaacttgaggggtttagagatcaggctcatctctgcttataaggaggacttcctggagatgatcccaatagatcacccttcacttttgaagaatagcagcttctagctgaccatgcaaaatctctgtttgtttttaaagactgtttcaaagattaaatctatacaaccacttttatgaccaaaaaagttgttgtgtcccaagtgtcctaattagaaaggcagctggctctcctgcagctcccaggcttgtgtagtcaagtgcagtgaactgggcagtaatcagctcaggaccattggctctttcctcctctttcagctacagacacatgccctggcttttgcattgaccttgctttgttagttctagactaatttatccttttgtcagacactttcccttttttaggatactcacaacagagtccactttcagctattggaatacattttaccataaagcccccaaggctttctacccataacaccaacacaaaaaaccaattaagttgcagaggggggaaataatcacaaacttttggcaacctgcttaatgctagacgctctgttttcactggttattctgagtgtcatatgcagatgcagatccaagggagacagggctaaatggtggtgtcaagaattcctcccacaccccaaaaattctttccaatatttgattattaaaatatctatcatttctccaccttgtgtctgtgtcttaagtgtctgtgaatattgtaaaagtgctgtatgtttagtagtgttgtgtgcctggcagtgctgactatgactactgtgccatctgtctgtgaccttgatgtcaggtacctggccatggggctaccagcaaggatgtgcaaaggaagaaccgctgcccctgccctcagcttccttatgcccgagccactacttatccgtgaatgtgagtgccaagagaaacctaatttggtggggaagccaaggaatgggagaacgttttttctgatttgagtcaaggcactaattattagacactctcagacaacaaagcggtattgacctgagatcaaaggaagcagggacaatattgtagaatgctaggacactggaaatgaagaggccttcagcttcgccagtcttgattcttgactttacaaatgagaaaatggagaaacagggaggctaggtgatttgccccagatgacactgtcaattagtggagaaattatgattcctcctctagtacttcttggtcttaccagcatcaaatgaagctgggctcacagggaaagtggtttttggtctgggatctgcagagcacataaaataagttagaaagtctataaaagaggaaaaaaggttctcctctccctcccaaaaatgacttcccaacacagaacaataaaggagatgcttgtgtgggtatgcaactgtccaccaattatcacctaccttctccctgagatgaaacaaaacacgcttggtaaatcatgatttgataaataacaattaagttactggtggttcatgcttgacagctgcaatcttacccaataagctattcatcttagtaaaaccttgttttagtaatatacatgcataatttagaagttgaaggctgaaaattgttgtgttcttctccatatatatacaactttcatcggggtcccttgagttaagaaatgccttctattttataggtaatctcaacagcagactttgaaatattgtgtttggttcaatatgctaagaagatatacaaataataataacttcgtgagtcttcatgtgcaaaatgacaaactgagcaattttctgtataattctagattcttaaaaccttttttcccataattgtttgaatgcactaggcacaagtttctgtttaagcctctgcttctccctgaatgtgtagaactgtcactttgcttacaaaggggctgtgtgtttgtggctggcagcccagatagagcactctgggtgctggggattgagggcaccttggccagctgattgacctgtctggactctgtggcccaattaatcgaggccacagatcagttggtactaagcatcaaaatgattcattatgcctctctcacactccgattgctttgccacatagataacagcatttgaaatgggaaacactttagaatgtcattattgtattatatattgtcatcttatgcagtatttctgaaaatttatttttattgtgatgactgattgaagacatatgtgtatgaatagatgttcctcagtgaagcctattctcttgttgttgatgacagtggcatcagagtgaagagttgttgcagagtaactgacttcagtttaaggttaccctggggttctggggttaggacccggattatgcagctgatctcccagcaaacacagctgtatgaaataagcaactcttcaaaatacaattcttgccactcattctggacctttgattcataatgtcctgggataagtccaacttacaaagattcccaggtgattcgtgtgaccaccatttggaaaccagtaatatatacatccggagtcatatataccattttgaacaaagtagctaaatgcttatctctccttgtgcgattagtttcacatgttcgttgaggttatcatgttaaatggcaatatagacacagtcttagtgattcaacaattcagctgtttcagccgaattgaccagttgctaatttataagcaaattgtaactgatcaatttagtcagaatggatgcaagcccaaagacaaggtggagagcaagctttaatatacactttgtctcaaggccagctcttcatatttccctctttatatttcaaactaagaggcagatctcaggtcactcatctttagaattggtgagaatgagaaacagggaactgaagtgattcattcagattcaatttggaagtcattcccagagcctaaaatatttatctaaggggtctgatttatcaacctcaggtagtctccaaaacacaaaggtattcaggctaaaataaaaccaatcaaaaaaggaaattcaggaggctccagttctaagactaacccagtataacaagggtgatcagttattacttgtggccttgtaccacctctgttggataatgtgccaccgtcctaatgaagctttggccagacttctttctatagctgtgcacatagaaaggctttagacaacagtgataccaaagggttcctttgattttccttctgtgtgattctcagacagttttagctctttggtgtgctgccaaatgtttaacaactggctctggaaaacagtggaacccagatttttagcacctaccaatttctatggtgtaaatactctcatctcagccaatttcaggctactaacttaatgtcaaccagctgaaaacacaacaatatgttttcaagagccagtataagttggctccaatacagcatgagccagctccagcatagcactgcctgaacaatttttaagtcagtgagtaccaaataggagaggctagcagaggctttggagggacttttaaatgtcccctccaccaagggaagcatttccatgttggttagttttactgatttttagtaaaagagcatattattggatcccaaggtgttcaaatattccacgtgactcttaggaacctctcaacagactccccagtatcttgggagattaccaactgtggcttttctaatttctaagggtgaccctccaggaaaacattctttaatttaactaccagttaaaaccatgtttggctgatcttttttaaaaaatctatacctatagttcatcacttgtttccccaactttgtcattttccctatccacttgcccctcatccttctgacacaataaaaaaaatacaggtacccacaaaacagtgcctgcaaaggagcaggggaagaacaaggcacccagtaagctcacttggctctacatatctggaaaggcactgaggttccaaggtctctaccccaccaggggacacccagtaaacatcacgctgagagtttaagttgcactcaactggagttgatttgcccttagaaaagtttccaacggtgaagaaataccacttggtaggaatatctctgggcaacttcattgctgactgggcaaactttgtaggataaggtgtcatgtgatgtaaggctggaccatgaaaaacaaaaatctactaatacacatttggcccctgcagtcccctggcattgagcaatagagcaactgtcctttctcaccactagttgtgagtgtacttccaactgagtgtttagaaatcaggtaatctggtaatccacagaacaagctttgtttgcaaattgcaaatttttctggtagaagtcattcttaggtgggcttcattaaatctttggagaggcaatgctgggaaaaaatatgcctaattcctaggacacagtgagtggccgtaagttgttatctgcatgtactaaatcaaaattagatcatgaaggaccaaatctacttccgttgctataataaaataccctacaggttctgtaaggcatttctaaactgtaaatgcttgaaacgcaagttggacattttctatactatgtgtaaaatgccaggttatacctctattttctttcttcctaatggtcattgaaatgagcttgtttctctacattgagcaagctacattttattttaaatgagtcaggtgcatgttcagatgtctgtattcccaatacattgcatgcagcctgagcacaagtatgccttcaccctctggctcttttcctgacaccaaacagagaagtccacagctacaagcacaaggggcttgacaggtaggccttgttttattatgaacaaattcaccagaaaaccattcttgaggaaccagccactcccatagcatttttagtcttagggaagaaaattggcagggaagaaaaattggcagacaatgggaaagaggtttggtcaacctgcataagtggaataaagtcattgaagtacttgcaaaaagaagagggaggtttccctctgaaggaatctagaccattttttaatatggagaataactgtaccccatgttagaagtgctctttagccatatttcaagatccagatctgaacccatactgtgcagaaaagcacaagagcgcttacagccaagagccctgggaggagttgagtaacaggctgagatccggtcaccaagcatcattagttagcactgaaattctcccaggacacaaaacaaatgtatggaaacatcgcaatacactatcatttactcacatgggacaaccacctaagtccatagcaaaactttacagatctagatgttatctcaagtcaggattccagatcaacatcctccatgtggagatgagacaactgaggttcagaaagttggagtgacttatttgcccagctagctaactggaattagagtctgggtctcccaaccactgattctgctacaccacactgtgctgcttccattagttagatggacattgacaattaattgtgaaagcattaattagaagtcaagacaaaagaatgtttgtgatatcttctctcgcttaacatactttgatttcaccattgcatttcagcattttaaagaatagtgtatcagtatagaaggaggagcaaagctctttaagagtaatgatgaaaccaaaaggtcaaaaagtagaagaatagcgaatgtaagttattaaataaatgagcaagaagtatgtgtcagggaaaataaatgcttcttatattgttaataccgtgattccctgcccgctcaccccgtcactcaacacttgatgcatttgttttggaaagtgccattttatgctgagatactggtattgaaaacttccctctttcccaactctgtcagaagttctcttgctctttggaagaagccgagggccttaacaaatcagactgacctcccttgtgacaggcagcctcgcctgcccttggaaacaagctgccagaatgtgagggccacagagacccaagagaagccagcactgctagactgaggaacttgtaaatatcttctgctttcttggtgaacaaggacagaggcaattgcgtgtatattgtgactgtagtttgtgaagaaaatgcaaccatttgcttcgacagctcctcaaatgtacttgttaagtgtgaatgtgcctgcctcattgccttgtgttccaaacacagtactgaatgcgttgtttttaaataaaccatttcgttttgctttgggaaa

SEQ ID NO: 6627 - DNA, 3585 bp, Homo sapiens
gctgcagaagctgccgccacctccaatgcacaaggtgtctcatctgaaaagaaacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgtaatctagctcctgtggtggagtttgctgcagatgtgggaactaaatcagattttattaccatgaatccatcagttgtacaaagagcatttggaggctttcgaaatgagagtgacagagaaaaatttgtgcatagactttccatgctgaatgacagtgtcctttggattcctgctttcatggtcaaaggaggagagaagcacgtggagtgggttaatgcattaatccttaagaataaactgaaagtgcgaactgcctatccgtcattgagacttattcatgctgtcagaggttactggctgaccaacaaagttcctatcaaaagacccagcacaggtcttctcatgtatacacttgccacaagattctgtgatgaaattcacctgtatggattctggcccttccctaaggatttaaatggaaaagcggtcaaatatcattattatgatgacttaaaatataggtacttttccaatgcaagccctcacagaatgccattagaattcaaaacattaaatgtgctacataatagaggagctctaaaactgacaacaggaaagtgtgtaaagcaataaagcacattttgaaacaaacaatatgcacttcttttctgaagatgcttccgaagatttgaaaataggatccaaaacacggctgggtttcagcatccaccaatgaactgaaaggtgaataaaggacgttcatgagaaatcgactaccagctgatgaaatacctgcaaagtgctctaaaaattaaatattttgactttaagggtcctagtaagtgccacttccactaagaatacagtttgaatgtataatcagtagtgtttacaagatccaacagtgcactcatcattagttaacaaagcaaatatgttcatcactgtcaggctgcccacagcaacaccaagcatattagaagaggaaccccaggaacgcaactcagaccttgggaaattaaaccatccttgtcagcagaagccaagatggaagcagtttgagcaatgaaatccgtaagattaaacaactcaagtaaatgcttcagtcaggactctgagtctgatcatgaattttatgttttaatttatgttttttttttgtcttctggaatctcttttggtttggatattgggatgcttagaaatcctttctgagatgcatatgagtgaggaaataaactttaagtaattatttttaaagttcttatactttttaaaagctatcacacaaagacttttttttttttttttgtctcgctctgttgcccaggctggagtacagtggcgcgatctcagctcactgcaagctccgcctcccaagttcactccattctcctgcctcagcctccggagtagctgggactgcaggcgcctgccaccacgcctggctaattttttgtatttttagtggagacggattttcaccgtgttagccaggatggtctcaatctcctgacctcgtgatccacccgccttggcctcccaaagtgctgggattacaggcgtgagccaccgtgcctggccgacatttttaaaaaagttttattttgcacggctctaaacctccatgttattttccagtggtgtagaaggtaccagctaaagtgaaccactatgtaatattaggccattctaaaggaaagatgttccatgtcatcagagatggtaaaataggccgggaaaaaaaaatctttggtaccaaagattacacttgtgtttctacacagcaaaccatttttctttcatgaaaataatatattattaacatgaatatattattttgctattaatgtgaaagttgtctctaaatattttttaattttcaaactcatactttattttcatttgaaatgtttttcacaccttttgcattacataataattttgtggaagcattttgccctttagaataaatattagattgatatagctgaaatgtgacttccagttctttgatattccccttgttattcaaatagaaatatggaaatgctttatatattactgttaaatttcttagtgcagaaataacattattaatagagtattgttttcaaaacagagatgattaatttcaagaggtttaacagtgaaattgtgtcaatattttgcatttaaaatgaatttaattgaccgatattttctgtagttaaatttagtcacaatatcacatatgttcttcaagaaacacatgaaattattaataaagtaattaaaaaatttttaatgtataacagaattgaccaataggccagttttctggtaacttatgatagtagattgtttctttagaaactgggcagaagctctgcattctcacttgtactttgatttcttatttcttgggcaggcaatttgaggaaagaagaaatggcatggggaatatatatgttttgtttcttagggaaaacagtctgagaaatgaataaaaagcatgaagtacgtgtgtgtgtgtgtgtgttaccatggaaaaggatattcacagtagtacagttctcaatatttttaattagatgtcatatttttttaatatagtaaaaccttgggatatagaatattacatcttttgagaatgtatgtgtctctaagtaagtaaaatctaatgcgtataggagactgatagctaaaaatgaatggaacattaatgtacttttataattaaacctcttatctatcagaaattgtaagagaatagatacatgttttgaatgtaaagttgaaaagtctggtttacttaataaattgaaagtgatttataaaatctaaa

SEQ ID NO: 6628 - DNA, 1794 bp, Homo sapiens
aacctgagccccagggaggcggcgcggagcgaccctggcagagctggcgcaaacagggcgagaggtcgctgggcagcgttcgaggaccagagggagctcggccacagaagaccccagtgatctgatcccgggatcccggctccaagctctcctcgcattttacagatttcacccccgcgactatctccccaaaacggagcctttatatcaagagaaggtgcgggagctggggcaaccaggactttctcgggcacccaagatgcgctccattaggaagaggtggacgatctgcacaataagtctgctcctgatcttttataagacaaaagaaatagcaagaactgaggagcaccaggagacgcaactcatcggagatggtgaattgtctttgagtcggtcacttgtcaatagctctgataaaatcattcgaaaggctggctcttcaatcttccagcacaatgtagaaggttggaaaatcaattcctctttggtcctagagataaggaagaacatacttcgtttcttagatgcagaacgagatgtgtcagtggtcaagagcagttttaagcctggtgatgtcatacactatgtgcttgacaggcgccggacactaaacatttctcatgatctacatagcctcctacctgaagtttcaccaatgaagaatcgcaggtttaagacctgtgcagttgttggaaattctggcattctgttagacagtgaatgtggaaaggagattgacagtcacaattttgtaataaggtgagctttcttctgctttttgagattgtaagtttttcaaagatattttacttgggggtggaaaactgttagaaaattttaaagtattactaaaacctcaaacaaatatttgtctatgatatccttttctgtgcaacatttaaattacatttaccctggaatagaatattataattattgcgtagttgaaagaaaaagtgatcctgtcatagcaacaagattcacacagctttttttggtgaggtgaggggggaggcaaatggcaattttattaaatttaatattccacacaaacttttttcttagtatctcttcttcatactcattagttttgtgtgattttatttgttgtataaagattatgaatattactatggaatgatgtaatagatttatgttaatgttactttttattaataattatctaggagatagtaagaacatagtttagcaagtttatatttgatatcctgagccatatttctttaatttctctttatatgtggtatttgtgtatgttagtatatttgaattttatgtttttttaacataattaagcgtgcatgtttgtttttcattaacggttaaaagatatttgatgaattgtgtgtttgattaacctattaactgaaaaaaactcaacagtagaaatggaattataatcacatcataaatataagcagtttttaatgatcaatttttatatctgtacagtttttttggattgttttagttccttagaaaaattagctaaatgacagaaacatggatattgaaatatgaaatagtacaatataaagatagatagaaaagtatgctgagttgacatgttgaaaaacacagtctcttgaagatatactggaatacattatttttgaatattttgaatattttttgaatatttttaaataaagtcttaaaagcataaataggtaactacttttaaaaaaaaagtcatgagaaatcacactcaagcattatcaagtgaagaaaattcataatagcaaataaaactgcaaacattttacctta

SEQ ID NO: 6629 - DNA, 2716 bp, Homo sapiens
ttttaattccaagattcaaacccggcgttttgcgctccgcccctccccctccccacggcccgcctatcattagccagactgcgcgggtgttttgtacgccccctccccccgtccctatcggcagaaccggaggccaaccttcgcgatcccttgctgcgggcccggagatcaaacgtggcccgcccccggcagggcacagcgcgctgggcaaccgcgatccggcgccggactggaggggtcgatgcgcggcgcgctggggcgcacaggggacggagcccgggtcttgctccccattggccgccacctcggcgggaggggccgcctccggctcgtggcacctggcgtctcccctccgcggggaaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtaccccgcgcccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctctacatcactcaccactactatgacaacgtcaagccgcgtcccggcttccacgccatgccctctgagatcttcaacttcctgcacttgcacagccgaggcatcctccgcgtgcacacgggcacctgcagctgctgctgatggctgccagccaggctgcccggcaagcggcgccccctctcctgctgtccctcctggtggaactgggagccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctgaaggaagaccctacagagaatggaattgagagtggagacaggacacttcacaggacacttgagcacagtcaagattttattcacacttttggttcctgtgttttatatcgaagacttagctatgaattgctatctaaatctcagagcttagaagccaacccagtgactagaccttccagtgaagaaagtgatctcaagaggtccagggacttaacagccaagccacaccacccgacaggttcttctgtgacaccgagagatctaacccaaggcctgggttatgtcttagtcgagacatcatcatctgagaagcaccacatcctttcagacacatcctcggacacacatgcggtcttggtgcccccaggttcaatcctgcgttagctcttttgatgagaaggaaataaaccaaaccagccacttgcactatggcttccaagccaatgttattgactcaataagtgcttagcaattggcttcctcttttgtcttcctattttcagctccatttaaaccaggagttatttataaagacctcttcctctcatgt

SEQ ID NO: 6630 - DNA, 1499 bp, Homo sapiens
gaaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtaccccgcgcccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagagggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctctacatcactcaccactactatgacaacgtcaagccgcgtcccggcttccacgccatgccctctgagatcttcaacttcctgcacttgcacagccgaggcatcctccgcgtgcacacgggcacctgcagctgctgctgatggctgccagccaggctgcccggcaagcggcgccccctctcctgctgtccctcctggtggaactgggagccccgaaccgggcagcgtggggtcctggcgttcaggctgtctctccctccattgttcagctctgtacttggatcctggggtagggaggca

SEQ ID NO: 6631 - DNA, 1914 bp, Homo sapiens
aaatcggcggctacccggcaccggcgcctggaggtaaaggtacccgggggtggggaaggcccctggccgcggcagagctccctgccaccggccctgtcctgcttgccgccccagcgcctgcgacgcttggatgcccccagctccggccgcgccaaccagaaactttgcccctcgaagtcccccgcctgcctgaccgcaccgtgaggcgccaagtcggccgcgcgccccccggggccccggaaccccgcgagtcattgcctggccgccccgtaccccgcgcccgcggcgcccggtagccaggatgcgctacgcggacccctcggccaaccgggatttgttggggagccgaactttgctcttcatcttcatctgcgcctttgccttggtgaccttgctgcaacagatcctgtatggcaggaactacattaagagaggcctccagtttggttggcagagtggtgaccagctgaccaattggacggggctctttaatgtcacggatgatccagcagtgcagagcggcagtgactccagctccaggtactttgaattttatgaggggccttttgaatataactccacaagatgcctggagctgaggcacgaaatattggaagtgaaggtgctgtccatggtgaagcagtcagagctgttcgacaggtggaagagcctccagatgtgcaaatgggcgatgaacatctctgaggccaaccagttcaagtctactctgtccaggtgctgcaacgcccctgcctttctcttcaccacccagaagaacactcccctggggacaaagctcaagtatgaggtggacaccagtggcatctaccacatcaaccaggagatcttccgcatgtttcccaaggacatgccctactaccggtcccagtttaagaagtgtgctgtagtgggcaacggaggcatcttgaagaacagccgctgcgggagggagatcaacagcgccgacttcgtcttccggtgcaacctgccccccatctcagagaagtacaccatggatgtgggggtgaagacggatgtggtcactgtgaaccccagcatcatcacagagaggttccacaagctggagaagtggcggcggccgttctatcgcgtgctgcaggtgtacgagaacgcgtcggtgctgctgcctgccttctacaacacgcgcaacaccgacgtgtccatccgcgtcaagtacgtgctggacgacttcgaatcgccgcaagctgtctactacttccatccgcagtacctggtcaacgtgtcgcgctactggctcagcctgggggtgcgcgccaagcgcatcagcaccggcctcattctggtcactgcggcgctggagctctgtgaggaggtgcacctctttggcttctgggccttccccatgaacccctcgggcctctacatcactcaccactactatgacaacgtcaagccgcgtcccggcttccacgccatgccctctgagatcttcaacttcctgcacttgcacagccgaggcatcctccgcgtgcacacgggcacctgcagctgctgctgatggctgccagccaggctgcccggcaagcggcgccccctctcctgctgtccctcctggtggaactgggagccccgaaccgggcagcgtggggtcctggcgttcaggctgtctctccctccattgttcagctctgtacttggatcctggggtagggaggcagggttaggaaccggggcagagtcagctctgtgctgagcctcctggcctggcccccaccggtgcatccgcccagtgcgtccacctgccctggctagcatgctgctgggccacaccccaagatcaggggccctggggacggcaagtgaataaagcacatttccacccaattttgtcatccgagagagagcacaaactgcaggcccttgttgcagctg

SEQ ID NO: 6632 - DNA, 2276 bp, Homo sapiens
ggagccgcgagtcggggccgcccgggctgtgcttcgccccggcagcagcggtggcggcggcgcctgtggctcaggatgcggccggggggcgcactgctcgccctgctcgccagcctgctgctgctgctgctgctgcgcctgctctggtgcccggcagacgcgcccggccgcgccaggattctggtggaggaaagcagggaggccacccacggcacccccgcagcgctgaggacgctccggagcccggcgaccgcggtaccgcgcgccactaacagcacatatctgaatgagaagtcgctccaactgacggagaaatgcaaaaatctgcaatatggcattgagtctttctctaacaaaacgaaagggtattcagagaacgactaccttcagattatcacagatatacagagttgtccatggaaacggcaagcagaagaatatgcaaattttagagccaaacttgcttcctgctgtgatgctgttcaaaactttgttgtttctcagaataacactccagttgggactaatatgagttacgaggtggaaagcaaaaaagaaatcccaattaagaagaacatttttcatatgtttccagtgtcccagccttttgtggactacccttataatcagtgtgcagtggtcggaaatgggggaattctgaataagtctctctgtggaactgaaatagataaatccgacttcgtttttaggtgtaacctacccccaaccacaggagatgttagtaaagatgttggcagtaaaacaaatcttgtgactataaatccaagcatcataactctgaaatatgggaacttaaaggaaaaaaaagccctatttctggaggacattgcaacctatggagatgcattttttcttctgccagcattttccttcagggccaacacgggtacctctttcaaagtatactacacgctcgaagagtctaaagcaagacaaaaggttctatttttccatcccaagtacctgaaagatctggcccttttctggagaactaaaggtgtgactgcataccgcttgtccaccggcttgatgatcacaagtgttgcagtggaactgtgtaaaaatgtgaagctgtatggattctggcccttctctaaaactgtagaagacatacctgtcagccatcactattatgacaacaagctacctaaacatggtttccatcagatgcccaaagaatacagccagatcctccaacttcacatgaaaggaatcctcaaactgcaatttagcaaatgtgaagtcgcctaaacaaagtatcttaaaatgggaataattttaatataatgcagtaggtgattaacaatgtctccaaacaccaaaggaggtggctaaagagtattttgagatgagccccaaaatttggtttgaccaaagcttccccactcattttgcaatgatggcaagtcattcaatccttctcatcttcattttttctccttataacatggacaccatatctgactcatacaaatttttataatttatgaaaattattggcatggcctttggtgtgaggtagggactcaaagaatatttctttcttactatttataccagccatctccaccttcaccagaccgataataaaagcatgctttcttggagatctcttctaaagagaatagctgcattaccagtatccattggatttctttctgtggcaggtctctatcaataatatccttcccatttttctgtctcaaagactgcatgcaagaaaattatatacttaagcaaaaagttcttgatcattcgggaatgaaattcttctctgagtatggcagtatgcctgcttctgattaaattcacttttaatagtagctgtgatgatattttggttgaatttaagccatttattttcctcttatgtctacatttcttcatcacttaataattttattttaacttcctgcctcattcttacacttttttctctctcacttatacgatatacttcaaggacgtgaacagttacaatacccagtctttcttacctgttgtcttgcctgtggggtcactcactcaattttattttaaaattactgaataactacttcatgccaggccctgcaccaggctctgtgagaggacaagaaggattattgcctcttgtaggagaaaacagatgtgcatatcattaattatgatggggtatgataagtattacaatgacaaaagctatgaataaagtgctacaaggaacagaagcagggataattaaatccatttcagtggaatctatttcaatgtac

SEQ ID NO: 6633 - DNA, 1056 bp, Homo sapiens
ctgtgaacgctgtgggtgcgcggggctgcggccacggcggcggtggcggcggcggcgggagccgcgagtcggggccgcccgggctgtgcttcgccccggcagcagcggtggcggcggcgcctgtggctcaggatgcggccggggggcgcactgctcgccctgctcgccagcctgctgctgctgctgctgctgcgcctgctctggtgcccggcagacgcgcccggccgcgccaggattctggtggaggaaagcagggaggccacccacggcacccccgcagcgctgaggacgctccggagcccggcgaccgcggtaccgcgcgccactaacagcacatatctgaatgagaagtcgctccaactgacggagaaatgcaaaaatctgcaatatggcattgagtctttctctaacaaaacgaaagggtattcagagaacgactaccttcagattatcacagatatacagagttgtccatggaaacggcaagcagaagaatatgcaaattttagagccaaacttgcttcctgctgtgatgctgttcaaaactttgttgtttctcagaataacactccagttgggactaatatgagttacgaggtggaaagcaaaaaagaaatcccaattaagaagaacatttttcatatgtttccagtgtcccagccttttgtggactacccttataatcagtgtgcagtggtcggaaatgggggaattctgaataagtctctctgtggaactgaaatagataaatccgacttcgtttttaggtgtaacctacccccaaccacaggagatgttagtaaagatgttggcagtaaaacaaatcttgtgactataaatccaagcatcataactctgaaatatgggaacttaaaggaaaaaaaagccctatttctggaggacattgcaacctatggagatgcattttttcttctgccagcattttccttcagggccaacacgggtacctctttcaaagtatactacacgctcgaagagtctaaagcaagacaaaagtgcaaaacaaaaagaaaaactataaactccatcttgtag

SEQ ID NO: 6634 - DNA, 697 bp, Homo sapiens
ctacccttataatcagtgtgcagtggtcggaaatgggggaattctgaataagtctctctgtggaactgaaatagataaatccgacttcgtttttaggtgtaacctacccccaaccacaggagatgttagtaaagatgttggcagtaaaacaaatcttgtgactataaatccaagcatcataactctgaaatatgggaacttaaaggaaaaaaaagccctatttctggaggacattgcaacctatggagatgcattttttcttctgccagcattttccttcagggccaacacgggtacctctttcaaagtatactacacgctcgaagagtctaaagcaagacaaaagtgcaaaacaaaaagaaaaactataaactccatcttgtagatttgtagattcgccacaaccaagtctgactgtgacactcccaagaaatctgtatgtaatcagcattgcttaaatattgttagatctaatgtgatcttctgctcttaaaactcaagtacatctaagggcattgagaatggaaagtctgagttctggtactagacaagagcagccctttaggccaggcgcaatggctcacacctgtaatcccagcactttgggaggccaaggtgggtgggtcacttgaggccaggagtttgagactagcctgggcaacatagtgagtacccttctctacaaaaaacaaaaaaa

SEQ ID NO: 6635 - DNA, 7928 bp, Homo sapiens
ctgcctgtgctgtgcctgcctcctagagctcattccctacgccccgactctgtcctggacagcgtgcccaccagccatggcggggccccggggcctcctcccactctgcctcctggccttctgcctggcaggcttcagcttcgtcagggggcaggtgctgttcaaaggctgtgatgtgaaaaccacgtttgtcactcatgtaccctgcacctcgtgcgcggccatcaagaagcagacgtgtccctcaggctggctgcgggagctcccggatcagataacccaggactgccgctacgaagtacagctggggggctctatggtgtccatgagcggctgcagacggaagtgccggaagcaagtggtgcagaaggcctgctgccctggctactggggttcccggtgccatgaatgccctgggggcgctgagaccccatgcaatggccacgggacctgcttggatggcatggacaggaatgggacctgtgtgtgccaggaaaacttccgcggctcagcctgccaggagtgccaagaccccaaccggttcgggcctgactgccaatcggtgtgcagctgtgtgcacggagtgtgcaaccatgggccacgtggggatggaagctgcctgtgctttgctggatacactggcccccactgtgatcaagagctgcccgtctgccaggagctgcgctgtccccagaacacccagtgctccgcagaggctcccagctgcaggtgcctgcccggctacacacagcagggcagtgaatgccgagcccccaacccctgctggccatcaccctgctcactgctggcccagtgctcggtgagccccaaggggcaggctcagtgtcactgccctgagaactaccatggcgatgggatggtgtgtctgcccaaggacccatgcactgacaaccttggtggctgccccagcaactctactttgtgtgtgtaccagaagccgggccaggccttctgcacctgccggccaggcctggtcagcatcaacagcaacgcttctgcgggctgcttcgccttctgctcccccttctcctgcgaccggtctgccacttgccaggtgaccgctgatgggaagaccagctgtgtgtgcagggaaagcgaggtgggggatgggcgtgcctgctacggacacctgctccacgaggtgcagaaggccacgcagacaggccgggtgttcctgcagctgagggtcgccgtggccatgatggaccagggctgccgggaaatccttaccacagcgggccctttcaccgtgctggtgccatccgtctcctccttctcctccaggaccatgaatgcatcccttgcccagcagctctgtagacagcacatcatcgcagggcagcacatcctggaggacacaaggacccaacaaacacgaaggtggtggacgctggccgggcaggagatcaccgtcacctttaaccaattcacgaaatactcctacaagtacaaagaccagccccagcagacgttcaacatctacaaggccaacaacatagcagctaatggcgtcttccacgtggtcactggcctgcggtggcaggccccctctgggacccctggggatcccaagagaactatcggacagatcctcgcctctaccgaggccttcagccgctttgaaaccatcctggagaactgtgggctgccctccatcctggacggacctgggcccttcacagtctttgccccaagcaatgaggctgtggacagcttgcgtgacggccgcctgatctacctcttcacagcgggtctctctaaactgcaggagttggtgcggtaccacatctacaaccacggccagctgaccgttgagaagctcatctccaagggtcggatcctcaccatggcgaaccaggtcctggctgtgaacatttctgaggaggggcgcatcctgctgggacccgagggggtcccgctgcagagggtagacgtgatggccgccaatggtgtgatccacatgctggacggcatcctgctgcccccgaccatcctgcccatcctgcccaagcactgcagcgaggagcagcacaagattgtggcgggctcctgtgtggactgccaagccctgaacaccagcacgtgtccccccaacagtgtgaagctggacatcttccccaaggagtgtgtctacatccatgacccaacggggctcaatgtgctaaagaagggctgtgccagctactgcaaccaaaccatcatggaacaaggctgctgcaaaggttttttcgggcctgactgcacgcagtgtcctgggggcttctccaacccctgctatggcaaaggcaattgcagtgatgggatccagggcaatggggcctgcctctgcttcccagactacaagggcatcgcctgccacatctgctcgaacccaaacaagcatggagagcaatgccaggaagactgcggctgtgtccatggtctctgcgacaaccgcccaggcagtgggggggtgtgccagcagggcacgtgtgcccctggcttcagtggccggttctgcaacgagtccatgggggactgtgggcccacagggctggcccagcactgccacctgcatgcccgctgtgttagccaggagggtgttgccagatgtcgctgtcttgatggctttgagggtgatggcttctcctgcacacctagcaacccctgctcccacccggaccgtggaggctgctcagagaatgctgagtgtgtccctgggtccctgggcacccaccactgcacatgccacaaaggctggagtggggatggccgcgtctgtgtggctattgacgagtgtgagctggacatgagaggtggctgccacaccgatgccctctgcagctatgtgggccccgggcagagccgatgcacctgcaagctgggctttgccggggatggctaccagtgcagccccatcgacccctgccgggcaggcaatggcggctgccacggcctggccacctgccgggcagtggggggaggtcagcgggtctgcacgtgcccccctggctttgggggtgatggcttcagctgttatggagacatcttccgggagctggaggcaaatgcccacttctccatcttctaccaatggcttaagagtgccggcatcacgcttcctgccgaccgccgagtcacagccctggtgccctccgaggctgcagtccgtcagctgagccccgaggaccgagctttctggctgcagccaaggacgctgccgaacctggtcagggcccattttctccagggtgccctcttcgaggaggagctggcccggctgggtgggcaggaagtggccaccctgaaccccaccacacgctgggagattcgcaacattagtgggagggtctgggtgcagaatgccagcgtggatgtggctgacctccttgccaccaacggtgtcctacacatcctcagccaggtcttactgcccccccgaggggatgtgcccggtgggcaggggttgctgcagcagctggacttggtgcctgccttcagcctcttccgggaattgctgcagcaccatgggttggtgccccagattgaggctgccactgcctacaccatctttgtgcccaccaaccgctccctggaggcccagggcaacagcagtcacctggacgcagacacagtgcggcaccatgtggtcctgggggaggccctctccatggaaaccctgcggaagggtggacaccgcaactccctcctgggccctgcccactggatcgtcttctacaaccacagtggccagcctgaggtgaaccatgtgccactggaaggccccatgctggaggcccctggccgctcgctgattggtctgtcgggggtcctgacggtgggctcaagtcgctgcctgcatagccacgctgaggccctgcgggagaaatgtgtaaactgcaccaggagattccgctgcactcagggcttccagctgcaggacacacccaggaagagctgtgtctaccgatctggcttctccttctcccggggctgctcttacacatgtgccaagaagatccaggtgccggactgctgccctggtttctttggcacgctgtgtgagccatgcccagggggtctagggggggtgtgctcaggccatgggcagtgccaggacaggttcctgggcagcggggagtgccactgccacgagggcttccatggaacggcctgtgaggtgtgtgagctgggccgctacgggcccaactgcaccggagtgtgtgactgtgcccatgggctgtgccaggaggggctgcaaggggacggaagctgtgtctgtaacgtgggctggcagggcctccgctgtgaccagaaaatcaccagccctcagtgccctaggaagtgcgaccccaatgccaactgcgtgcaggactcggccggagcctccacctgcgcctgtgctgcgggatactccggcaatggcatcttctgttcagaggtggacccctgcgcccacggccatgggggctgctcccctcatgccaactgtaccaaggtggcacctgggcagcggacatgcacctgccaggatggctacatgggcgacggggagctgtgccaggaaattaacagctgtctcatccaccacgggggctgccacattcacgccgagtgcatccccactggcccccagcaggtctcctgcagctgccgtgagggttacagcggggatggcatccggacctgcgagctcctggacccctgctctaagaacaatggaggatgcagcccatatgccacctgcaaaagcacaggggatggccagaggacatgtacctgcgacacagcccacaccgtgggggacggcctcacctgccgtgcccgagtcggcctggagctcctgagggataagcatgcctcattcttcagcctccgcctcctggaatataaggagctcaagggcgatgggcctttcaccatcttcgtgccgcacgcagatctaatgagcaacctgtcgcaggatgagctggcccggattcgtgcgcatcgccagctggtgtttcgctaccacgtggttggctgtcggcggctgcggagcgaggacctgctggagcaggggtacgccacggccctctcagggcacccactgcgcttcagcgagagggagggcagcatatacctcaatgacttcgcgcgcgtggtgagcagcgaccatgaggccgtgaacggcatcctgcacttcattgaccgtgtcctgctgccccccgaggcgctgcactgggagcctgatgatgctcccatcccgaggagaaatgtcaccgccgccgcccagggcttcggttacaagatcttcagcggcctcctgaaggtggccggcctcctgcccctgcttcgagaggcatcccataggcccttcacaatgctgtggcccacagacgccgcctttcgagctctgcctccggatcgccaggcctggctgtaccatgaggaccaccgtgacaagctagcagccattctgcggggccacatgattcgcaatgtcgaggccttggcatctgacctgcccaacctgggcccacttcgaaccatgcatgggacccccatctctttctcctgcagccgaacgcgggccggtgagctcatggtgggtgaggatgatgctcgcattgtgcagcggcacttgccctttgagggtggcctggcctatggcatcgaccagctgctggagccacctggccttggtgctcgctgtgaccactttgagacccggcccctgcgactgaacacctgcagcatctgtgggctggagccaccctgtcctgaggggtcacaggagcagggcagccctgaggcctgctggcgcttctacccgaagttctggacgtcccctccgctgcactctttgggattacgcagcgtctgggtccaccccagcctttggggtaggccccaaggcctgggcaggggctgccaccgcaattgtgtcaccaccacctggaagcccagctgctgccctggtcactatggcagtgagtgccaagcttgccctggcggccccagcagcccttgtagtgaccgtggcgtgtgcatggacggcatgagtggcagtgggcagtgtctgtgccgttcaggttttgctgggacagcctgtgaactctgtgctcctggtgcctttgggccccattgtcaagcctgccgctgcactgtgcatggccgctgtgatgagggccttgggggctctggctcctgcttctgtgatgaaggctggactgggccacgctgtgaggtgcaactggagctgcagcctgtgtgtaccccaccctgtgcacccgaggctgtgtgccgtgcaggcaacagctgtgagtgcagcctgggctatgaaggggatggccgtgtgtgtacagtggcagacctgtgccaggacgggcatggtggctgcagtgagcacgccaactgtagccaggtaggaacaatggtcacttgtacctgcctgcccgactacgagggtgatggctggagctgccgggcccgcaacccctgcacagatggccaccgcgggggctgcagcgagcacgccaactgcttgagcaccggcctgaacacacggcgctgtgagtgccacgcaggctacgtaggcgatggactgcagtgtctggaggagtcggaaccacctgtggaccgctgcttgggccagccaccgccctgccactcagatgccatgtgcactgacctgcacttccaggagaaacgggctggcgttttccacctccaggccaccagcggcccttatggtctgaacttttcggaggctgaggcggcatgcgaagcacagggagccgtccttgcttcattccctcagctctctgctgcccagcagctgggcttccacctgtgcctcatgggctggctggccaatggctccactgcccaccctgtggttttccctgtggcggactgtggcaatggtcgggtgggcatagtcagcctgggtgcccgcaagaacctctcagaacgctgggatgcctactgcttccgtgtgcaagatgtggcctgccgatgccgaaatggcttcgtgggtgacgggatcagcacgtgcaatgggaagctgctggatgtgctggctgccactgccaacttctccaccttctatgggatgctattgggctatgccaatgccacccagcggggtctcgacttcctggacttcctggatgatgagctcacgtataagacactcttcgtccctgtcaatgaaggctttgtggacaacatgacgctgagtggcccagacttggagctgcatgcctccaacgccaccctcctaagtgccaacgccagccaggggaagttgcttccggcccactcaggcctcagcctcatcatcagtgacgcaggccctgacaacagttcctgggcccctgtggccccagggacagttgtggttagccgtatcattgtgtgggacatcatggccttcaatggcatcatccatgctctggccagccccctcctggcacccccacagccccaggcagtgctggcgcctgaagccccacctgtggcggcaggcgtgggggctgtgcttgccgctggagcactgcttggcttggtggccggagctctctacctccgtgcccgaggcaagcccatgggctttggcttctctgccttccaggcggaagatgatgctgatgacgacttctcaccgtggcaagaagggaccaaccccaccctggtctctgtccccaaccctgtctttggcagcgacaccttttgtgaacccttcgatgactcactgctggaggaggacttccctgacacccagaggatcctcacagtcaagtgacgaggctggggctgaaagcagaagcatgcacagggaggagaccacttttattgcttgtctgggtggatggggcaggaggggctgagggcctgtcccagacaataaaggtgccctcagcggatgtgggccatgtcaccaa

SEQ ID NO: 6636 - DNA, 8144 bp, Homo sapiens
accaagactcctggatttgccatttttcctttctgaaggcaggtctcacctatctcctggttcgatctaggaaaaaggaaaggaagggatttaaaagtaaacagtgaaatgagaaagaattcactgggagtttatcaaactaagttaaaatagctaagtcagcctgacaggtgcttggcacagagaaggagcaaatatttcctcatgatgctacaacatttagtaattttttgtcttggattggttgtacaaaatttctgctccccagctgaaaccacagggcaggcaagaagatgtgataggaagtctcttcttacaattaggaccgagtgccgatcctgcgctctcaaccttggagtcaagtgcccggatggttacaccatgattaccagtggctctgtaggggttcgagattgcaggtacacctttgaggtcagaacatactctctgtctctccccggatgccgccatatttgtaggaaggactatctccaacctcggtgttgtcctggccgctggggcccagactgtatagagtgcccaggtggagcggggtcaccctgcaatggcagaggcagttgtgctgaaggcatggaaggaaatggaacctgctcctgccaagaagggtttggtggaacagcctgtgaaacctgtgctgacgacaacttatttggacccagctgttcatcagtgtgcaactgtgtgcatggggtgtgcaacagtggactagatggcgatggaacctgtgagtgctactctgcgtacactggccccaagtgtgacaagcccatccctgaatgtgcagccttgctctgcccagaaaattccagatgttcgccttccactgaagatgaaaacaaactggaatgcaaatgccttcccaattaccgaggcgatggcaaatactgcgaccccatcaatccatgtttacgaaaaatctgccaccctcatgctcattgtacgtacctgggaccaaatcggcacagttgtacatgccaagaaggctaccgtggggatggccaagtgtgcttgcctgtggacccctgccaaattaactttggaaactgccctacaaagtctacagtgtgcaaatatgatgggcctggacagtctcactgcgagtgtaaggagcattaccagaatttcgtacctggagtggggtgcagtatgactgatatatgtaaatcagataacccgtgtcataggaatgcaaattgcaccaccgtcgcaccaggccgaactgaatgcatttgccagaaaggttacgtgggtgatggcttaacgtgttatggaaacattatggagcgactcagagaattaaatactgaacccagaggaaaatggcaaggaaggctgacctctttcatctcactcctagacaaagcttatgcctggccactgagtaagctgggacccttcacggtgctgttacctacagacaagggactgaaaggattcaatgtaaatgagcttttggtggataataaagctgctcaatactttgtgaaactccacataattgctggtcagatgaacatcgaatatatgaataacacagacatgttctacaccttgactggaaagtcgggggaaatcttcaacagcgataaggacaatcaaataaagcttaaactccatggaggcaaaaagaaggtaaaaattatacaaggggacatcattgcttccaatgggcttctgcacatccttgacagagccatggacaagttagaacccacatttgagagcaacaatgagcaaaccataatgacaatgctacaaccaaggtacagcaagttcagatctttgttagaggaaaccaatttgggacatgccttagatgaggatggagttggtggaccatacaccatttttgttccaaataatgaagcattgaataacatgaaggacggcactctcgattacctcctttctccagagggatctcggaagcttctggaactcgtcagataccacattgtcccatttacccagcttgaagtggccactctcatctccacccctcacatcaggagcatggccaaccagctcatacagttcaacaccaccgacaatggacagattctggcaaatgatgtggcaatggaagaaattgagatcactgccaaaaatggccgaatttacacactgacaggagttctcattcctccctccattgtcccgattctgccccatcgatgtgatgaaacaaagagagagatgaaactgggcacttgtgtgagctgttctctggtgtactggagcagatgtcctgctaactctgagcccacagcactcttcacacacagatgtgtctacagtggcaggtttgggagcctgaagagcggctgtgcccggtactgcaatgccactgtgaagattccaaagtgctgcaaaggcttctatggacctgactgcaaccagtgtccaggaggcttctcaaatccatgctcaggaaatggacagtgtgcagatagcctcggcggcaacgggacatgcatttgtgaggagggcttccaaggctcccagtgtcagttctgctctgatcccaataaatacggacctcggtgtaacaaaaaatgcctgtgcgttcacggaacatgcaataacaggatagacagcgatggggcctgcctcactggcacatgcagagacggctctgccgggagactctgtgataagcagacctcagcctgtgggccctacgtgcagttctgtcacatccacgccacctgtgaatacagcaatgggacagccagttgtatttgcaaagcaggatatgaaggagatggaactctgtgttctgagatggacccttgcacaggactaactccaggaggctgtagccgcaatgcagaatgcatcaaaactggcacgggcacccacacctgcgtgtgtcagcagggttggacagggaatgggagagactgctcggagatcaacaactgcctgctgcccagtgcaggcggctgccacgacaacgcatcctgtttgtatgtgggtcccgggcagaatgagtgtgagtgcaagaaaggatttcgaggaaatgggattgactgtgaaccaataacttcatgcttggaacaaaccgggaaatgtcatccattggcaagctgtcaatctacttcgtctggtgtctggagctgtgtttgtcaagagggctatgaaggagatggctttctgtgctatggaaacgcagcagtggaattgtcatttctctccgaagcagctatatttaaccgatggataaataatgcttctctacaacccacactgtcagccacctcaaacctcactgtcctcgtgccttcccaacaagctactgaggacatggaccaggatgagaaaagcttctggttgtcacagagcaatattccagccctaataaagtaccatatgctactaggcacatacagagtggcagatctgcagaccctgtcttcttctgacatgttggcaacatctttgcagggcaacttccttcacttggcaaaggtggatgggaatatcacaattgaaggggcctccattgtcgatggggacaacgcagccacaaatggagtgatacacatcatcaacaaggtgctggtcccacaaagacgtctaactggctccttaccaaacctgctcatgcggctggaacagatgcctgactattccatcttccggggctacatcattcaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgcccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaacaataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaaggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 6637 - DNA, 8251 bp, Homo sapiens
accaagactcctggatttgccatttttcctttctgaaggcaggtctcacctatctcctggttcgatctaggaaaaaggaaaggaagggatttaaaagtaaacagtgaaatgagaaagaattcactgggagtttatcaaactaagttaaaatagctaagtcagcctgacaggtgcttggcacagagaaggagcaaatatttcctcatgatgctacaacatttagtaattttttgtcttggattggttgtacaaaatttctgctccccagctgaaaccacagggcaggcaagaagatgtgataggaagtctcttcttacaattaggaccgagtgccgatcctgcgctctcaaccttggagtcaagtgcccggatggttacaccatgattaccagtggctctgtaggggttcgagattgcaggtacacctttgaggtcagaacatactctctgtctctccccggatgccgccatatttgtaggaaggactatctccaacctcggtgttgtcctggccgctggggcccagactgtatagagtgcccaggtggagcggggtcaccctgcaatggcagaggcagttgtgctgaaggcatggaaggaaatggaacctgctcctgccaagaagggtttggtggaacagcctgtgaaacctgtgctgacgacaacttatttggacccagctgttcatcagtgtgcaactgtgtgcatggggtgtgcaacagtggactagatggcgatggaacctgtgagtgctactctgcgtacactggccccaagtgtgacaagcccatccctgaatgtgcagccttgctctgcccagaaaattccagatgttcgccttccactgaagatgaaaacaaactggaatgcaaatgccttcccaattaccgaggcgatggcaaatactgcgaccccatcaatccatgtttacgaaaaatctgccaccctcatgctcattgtacgtacctgggaccaaatcggcacagttgtacatgccaagaaggctaccgtggggatggccaagtgtgcttgcctgtggacccctgccaaattaactttggaaactgccctacaaagtctacagtgtgcaaatatgatgggcctggacagtctcactgcgagtgtaaggagcattaccagaatttcgtacctggagtggggtgcagtatgactgatatatgtaaatcagataacccgtgtcataggaatgcaaattgcaccaccgtcgcaccaggccgaactgaatgcatttgccagaaaggttacgtgggtgatggcttaacgtgttatggaaacattatggagcgactcagagaattaaatactgaacccagaggaaaatggcaaggaaggctgacctctttcatctcactcctagacaaagcttatgcctggccactgagtaagctgggacccttcacggtgctgttacctacagacaagggactgaaaggattcaatgtaaatgagcttttggtggataataaagctgctcaatactttgtgaaactccacataattgctggtcagatgaacatcgaatatatgaataacacagacatgttctacaccttgactggaaagtcgggggaaatcttcaacagcgataaggacaatcaaataaagcttaaactccatggaggcaaaaagaaggtaaaaattatacaaggggacatcattgcttccaatgggcttctgcacatccttgacagagccatggacaagttagaacccacatttgagagcaacaatgagcaaaccataatgacaatgctacaaccaaggtacagcaagttcagatctttgttagaggaaaccaatttgggacatgccttagatgaggatggagttggtggaccatacaccatttttgttccaaataatgaagcattgaataacatgaaggacggcactctcgattacctcctttctccagagggatctcggaagcttctggaactcgtcagataccacattgtcccatttacccagcttgaagtggccactctcatctccacccctcacatcaggagcatggccaaccagctcatacagttcaacaccaccgacaatggacagattctggcaaatgatgtggcaatggaagaaattgagatcactgccaaaaatggccgaatttacacactgacaggagttctcattcctccctccattgtcccgattctgccccatcgatgtgatgaaacaaagagagagatgaaactgggcacttgtgtgagctgttctctggtgtactggagcagatgtcctgctaactctgagcccacagcactcttcacacacagatgtgtctacagtggcaggtttgggagcctgaagagcggctgtgcccggtactgcaatgccactgtgaagattccaaagtgctgcaaaggcttctatggacctgactgcaaccagtgtccaggaggcttctcaaatccatgctcaggaaatggacagtgtgcagatagcctcggcggcaacgggacatgcatttgtgaggagggcttccaaggctcccagtgtcagttctgctctgatcccaataaatacggacctcggtgtaacaaaaaatgcctgtgcgttcacggaacatgcaataacaggatagacagcgatggggcctgcctcactggcacatgcagagacggctctgccgggagactctgtgataagcagacctcagcctgtgggccctacgtgcagttctgtcacatccacgccacctgtgaatacagcaatgggacagccagttgtatttgcaaagcaggatatgaaggagatggaactctgtgttctgagatggacccttgcacaggactaactccaggaggctgtagccgcaatgcagaatgcatcaaaactggcacgggcacccacacctgcgtgtgtcagcagggttggacagggaatgggagagactgctcggagatcaacaactgcctgctgcccagtgcaggcggctgccacgacaacgcatcctgtttgtatgtgggtcccgggcagaatgagtgtgagtgcaagaaaggatttcgaggaaatgggattgactgtgaaccaataacttcatgcttggaacaaaccgggaaatgtcatccattggcaagctgtcaatctacttcgtctggtgtctggagctgtgtttgtcaagagggctatgaaggagatggctttctgtgctatggaaacgcagcagtggaattgtcatttctctccgaagcagctatatttaaccgatggataaataatgcttctctacaacccacactgtcagccacctcaaacctcactgtcctcgtgccttcccaacaagctactgaggacatggaccaggatgagaaaagcttctggttgtcacagagcaatattccagccctaataaagtaccatatgctactaggcacatacagagtggcagatctgcagaccctgtcttcttctgacatgttggcaacatctttgcagggcaacttccttcacttggcaaaggtggatgggaatatcacaattgaaggggcctccattgtcgatggggacaacgcagccacaaatggagtgatacacatcatcaacaaggtgctggtcccacaaagacgtctaactggctccttaccaaacctgctcatgcggctggaacagatgcctgactattccatcttccggggctacatcattcaatataatctggcgaatgcaattgaggctgccgatgcctacacagtgtttgctccaaacaacaatgccatcgagaattacatcagggagaagaaagtcttgtctctagaggaggacgtcctccggtatcatgtggtcctggaggagaaactcctgaagaatgacctgcacaatggcatgcatcgtgagaccatgctgggtttctcctatttccttagcttctttctccataatgaccagctctatgtaaatgaggctccaataaactacaccaatgtagccactgataagggagtgatccatggcttgggaaaagttctggaaattcagaagaacagatgtgataataatgacactactattatacgaggaagatgtaggacatgctcctcagagctgacctgcccattcggaactaaatctctaggtaatgagaagaggagatgcatctatacctcctatttcatgggaagacgaaccctgtttattgggtgccagccaaaatgtgtgagaaccgtcattacgagagaatgctgtgccggcttctttggcccccaatgccagccctgcccagggaatgcccagaatgtctgctttggtaatggcatctgtttggatggagtgaatggcacaggtgtgtgtgagtgtggggagggcttcagcggcacagcctgcgagacctgcaccgagggcaagtacggcatccactgtgaccaagcatgttcttgtgtccatgggagatgcaaccaaggacccttgggagatggctcctgtgactgtgatgttggctggcgaggagtgcattgtgacaatgcaaccacagaagacaactgcaatgggacatgccataccagcgccaactgcctcaccaactcagatggtacagcttcatgcaagtgtgcagcaggattccaaggaaacgggaccatctgcacagcaatcaatgcctgtgagatcagcaatggaggttgctctgccaaggctgactgtaagagaaccaccccaggaaggcgagtgtgcacgtgcaaagcaggctacacgggtgatggcattgtgtgcctggaaatcaacccgtgtttggagaaccatggtggctgtgacaagaatgcggagtgcacacagacaggacccaaccaggctgcctgtaactgtttgccagcatacactggagatggaaaggtctgcacactcatcaatgtctgcttaactaaaaatggcggctgtagtgaatttgccatctgcaaccacactgggcaagtagaaaggacttgtacttgcaagccaaactacattggagatggatttacctgccgcggcagcatttatcaggagcttcccaagaacccgaaaacttcccagtatttcttccagttgcaggagcatttcgtgaaagatctggtcggcccaggccccttcactgtttttgcacctttatctgcagcctttgatgaggaagctcgggttaaagactgggacaaatacggtttaatgccccaggttcttcggtaccatgtggtcgcctgccaccagctgcttctggaaaacctgaaattgatctcaaatgctacttccctccaaggagagccaatagtcatctccgtctctcagagcacggtgtatataaacaataaggctaagatcatatccagtgatatcatcagtactaatgggattgttcatatcatagacaaattgctatctcccaaaaatttgcttatcactcccaaagacaactctggaagaattctgcaaaatcttacgactttggcaacaaacaatggctacatcaaatttagcaacttaatacaggactcaggtttgctgagtgtcatcaccgatcccatccacaccccagtcactctcttctggcccaccgaccaagccctccatgccctacctgctgaacaacaggacttcctgttcaaccaagacaacaaggacaagctgaaggagtatttgaagtttcatgtgatacgagatgccaaggttttagctgtggatcttcccacatccactgcctggaagaccctgcaaggttcagagctgagtgtgaaatgtggagctggcagggacatcggtgacctctttctgaatggccaaacctgcagaattgtgcagcgggagctcttgtttgacctgggtgtggcctacggcattgactgtctgctgattgatcccaccctggggggccgctgtgacacctttactactttcgatgcctcgggggagtgtgggagctgtgtcaatactcccagctgcccaaggtggagtaaaccaaagggtgtgaagcagaagtgtctctacaacctgcccttcaagaggaacctggaaggctgccgggagcggtgcagcctggtgatacagatccccaggtgctgcaagggctacttcgggcgagactgtcaggcctgccctggaggaccagatgccccgtgtaataaccggggtgtctgccttgatcagtactcggccaccggagagtgtaaatgcaacaccggcttcaatgggacggcgtgtgagatgtgctggccggggagattcgggcctgattgtctgccctgtggctgctcagaccacggacagtgcgatgatggcatcacgggctccgggcagtgcctctgtgaaacggggtggacaggcccctcgtgtgacactcaggcagttttgcctgcagtgtgtacgcctccttgttctgctcatgccacctgtaaggagaacaacacgtgtgagtgtaacctggattatgaaggtgacggaatcacatgcacagttgtggatttctgcaaacaggacaacgggggctgtgcaaaggtggccagatgctcccagaagggcacgaaggtctcctgcagctgccagaagggatacaaaggggacgggcacagctgcacagagatagacccctgtgcagacggccttaacggagggtgtcacgagcacgccacctgtaagatgacaggcccgggcaagcacaagtgtgagtgtaaaagtcactatgtcggagatgggctgaactgtgagccggagcagctgcccattgaccgctgcttacaggacaatgggcagtgccatgcagacgccaaatgtgtcgacctccacttccaggataccactgttggggtgttccatctacgctccccactgggccagtataagctgacctttgacaaagccagagaggcctgtgccaacgaagctgcgaccatggcaacctacaaccagctctcctatgcccagaaggccaagtaccacctgtgctcagcaggctggctggagaccgggcgggttgcctaccccacagccttcgcctcccagaactgtggctctggtgtggttgggatagtggactatggacctagacccaacaagagtgaaatgtgggatgtcttctgctatcggatgaaagatgtgaactgcacctgcaaggtgggctatgtgggagatggcttctcatgcagtgggaacctgctgcaggtcctgatgtccttcccctcactcacaaacttcctgacggaagtgctggcctattccaacagctcagctcgaggccgtgcatttctagaacacctgactgacctgtccatccgcggcaccctctttgtgccacagaacagtgggctgggggagaatgagaccttgtctgggcgggacatcgagcaccacctcgccaatgtcagcatgtttttctacaatgaccttgtcaatggcaccaccctgcaaacgaggctgggaagcaagctgctcatcactgccagccaggacccactccaaccgacggagaccaggtttgttgatggaagagccattctgcagtgggacatctttgcctccaatgggatcattcatgtcatttccaggcctttaaaagcaccccctgcccccgtgaccttgacccacactggcttgggagcagggatcttctttgccatcatcctggtgactggggctgttgccttggctgcttactcctactttcggataaaccggagaacaatcggcttccagcattttgagtcggaagaggacattaatgttgcagctcttggcaagcagcagcctgagaatatctcgaaccccttgtatgagagcacaacctcagctcccccagaaccttcctacgaccccttcacggactctgaagaacggcagcttgagggcaatgaccccttgaggacactgtgagggcctggacgggagatgccagccatcactcactgccacctgggccatcaactgtgaattctcagcaccagttgccttttaggaacgtaaagtcctttaagcactcagaagccatacctcatctctctggctgatctgggggttgtttctgtgggtgagagatgtgttgctgtgcccacccagtacagcttcctcctctgaccctttggctcttcttcctttgtactcttcagctggcacctgctccattctgccctacatgatgggtaactgtgatctttcttccctgttagattgtaagcctccgtctttgtatcccagcccctagcccagtgcctgacacaggaactgtgcacaataaaggtttatggaacagaaacaaagtcaacag

SEQ ID NO: 6638 - DNA, 3420 bp, Homo sapiens
gagctgactggcatctttagatggatggtcctcagtccagtccttccattttacaggcgaggaggcggaagcttggggaggctaagcgcgctgagctggcggcggagcggagcttccactagggctcccagtttccccgcaccgcgcccgccgtcctccgggccacccatcccacccgaacgcgccaccgctctagcccgcgctccagcccgcgcgtcaccgacgcccgcggcctctcccacctctaagttccaggaagctctcggcctctagctgaccgcgttgctgctgagcttccctggggagaaggcgccgaggtgcccggtgcgggccgaggcagggctgggcctcgcgggcagcaggcggaagaaggaagggcggtggggcaggtcccggctgcgcggggcagttgtgcgcacttgggttcttcacgcgggacacacgtggaacgccgacccctgcgcccctggccgctggcaactggcaaggccgggaacagaaagtgtagggacagaagagcgctggagtcttccccgggagggagcccggggctgcagcccaggggcggggagcggggcggggctgggaaagttgagtactggtcgctcagggccgggctccgccggagtgcccggcgcagaaaccgtaaaaggctggagcgggcggggtaggtgtggctctgtgtgcgtgacctgagccccggtcccagtccctgtagtctcctgcggccgcggcctctcagccatgggcgccgtctggtccgccctgctggttggagggggtctggccggagcacttttcgtttggctgctgcggggcggccctggcgacaccgggaaggacggggatgcggagcaggagaaagacgcccctcttgggggagctgcgattccgggaggccatcagagtggcagcagcggactgagccctggaccttccgggcaggagctggtcaccaaaccagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaagaggctgaggttgtggaacacactgaataaaataaaggcagtgtgactccaaattcagccatctgaattgtttaaatttgctagtggattttgtctaatgtgcagaaatatatatgtctaatgtgcagaaatatatatgtgtgtatgtgtgtatatatatgcacacacacacagataatgcttccagtgaatgtgaacttcttttccctgtggcactgattgacagacttgtgctgatccattattactttagggcttgattctcttggggagtgacttggctaagcttcaggtgtaaactgtggtcacggagcaaaaacattaaccagctgcccagggttcaagcttgagcctttaggtgatctttaaactatggtagtaaaataagcctcactcaaacatagctgacttcctattggtacagcttgaaaagcactttttactacatacacattttatgcttaaaaagttaacatgatacgaaactgtgattagaaaatatctggtctggatgtgattagtaaggatacaagataatgttctaagactgcctaatgctttttgtttgattttcatctgccaggcgttgttatgtgctatgagggtagcaagtacgtctttgtcttaatgatctaaggctggtgtagaaacaaagggcctaatgagaaccaatcatcatggaagtcagttgcgggggcagcccataaggaaagggaaagtgagtggggttgggcataggctgagtgaggtggcctgaatgacacctcttagaggactgtgaagtacaggcacagcccgactgcagggagggatgcacccatcatttacccatgggagcatctgtaggaccatctctctcccacttcttctcccctcccccaccgcatctggccagatggactgtcctacagcaatcgtttccatctgtcaccctcttccctctcctttcataccagtcactatcttgggtaacaaatttatacaggacagtggtacagaaatacatctttgctctgagaatacagcaaatattaacttaaattattataactgaacaaataataaaacctgaattttaatatcttcatttgatgtctgaattatttgtctaaattttagtatcacaatagcctagatgtaaaataaaatacaaatattttcctccactaataagagacatatacagaaaagcaaacatcaaaaggtacagaagacatgaagattctgtttttctcctccctttggagaaaaagttgacaatatttattctcaaagttcacctttgactggagggaaattcagcacgcctgtacttgaaaatgaattcttacatgttaaaataacttttaataagtttaacatctatcagtgaaataatgtttaatccttttaaacagatggtctttgctgaaaagaataaacccaactgaaaatagcattagaaagtacttaaaagaactatgtttgacagtttttggctcatagcacttttatgttaaattcatgtatactgtttacagacttcataatgaattttatattgtaccagtaagctc

SEQ ID NO: 6639 - DNA, 1484 bp, Homo sapiens
aagctagggccaccatggcggaccgcaggcggcggctccggccggggacgttggccccggtgcgcgagggcgtgaactgcaggtccagctcttatcaaaggtgctggaagtgcttgatcctgaccggaagctggaggacacatgggcttattgtcaggacaccaggaaaggaatgaaggaacccacgaagcttttaaaaaaacattctacccaagtctacctgggaccttccaagaagacgtctgtgtcaaacgcaggccaatggctttatgaagaaaagccacataaaatggatttgctccatgaaaatggtcctcgtcctggtcttcatgaaaatgtatgcaaagcagttagtgacttctgcaagtgggttactacttttggaatttcggacatcgatgaagagttcatcttgaaacagtttgacattgactatgagaccaaaccaagccatgatgcgctccacacgatgaagctaaatcaggttcctctggagctaaagcgtagtgtggggctcagtaaactgcaggagacagagttcttccagaaactaggctatgagaggaaactccagaaaccacagagcatcttcaagaaagcaatggacatttgatttctaagaccaaagaccttggtaaactgcaagcagcatcatggagattgcagaatccttccagggaagtctgtgacaattcaagagaacatgttccttctggacagtttccagacacagaagctccagctacctctgagaccagtaactctaggagttactctgaagtttcaagaaatgaaagccttgaatctcctatgggagaatggggattccaaaaaggacaagagatatctgctaaagcagctacatgttttgcagagaagttgccttctagcaacctgctcaagaacagagctaaagaagaaatgagcctctctgatttgaacagtcaggaccgggttgaccacgaggagtgggaaatggtgcctaggcactcatcttggggggatgttggtgtgggtggcagtcttaaggctccagtgttaaacctaaaccagggaatggacaatggaagaagcactttggtggaagcaagaggtcagcaagtgcatgggaaaatggaaagggtagcagtgatgcctgcagggtctcagcaagttagtgtcaggttccaggtccattatgtcacaagcactgatgtgcaattcattgcagtaactggagaccatgagtgtcttgggagatggaacacttacatcccactccactataacaaggatgggttctggtctcattccattttcctgcctgcagatacagtggtggagtggaagtttgtgttggtagagaatgggggagttacccgctgggaagaatgcagcaatagattcctagaaactggccatgaggataaagtggttcacgcatggtgggggattcactgattcagtttgcaaagtaatggagaagctgtagaacaatgtggaag

SEQ ID NO: 6640 - DNA, 3368 bp, Homo sapiens
gcggaaggcgcgggagcttgcgtgctgctgggcctgagctgtctgtctcgtttctgtccgcgcgccctgcatcccggccccgggcgcccgctggaggtcgccgaggagccacagggctgactggtctgctgcccgggcccaggagtgcctggtgtagcagtcgcggagccatcccggcgtctgctgccatgaccgactctcccctcagaggagactcttcctcagcggtggctgcagagacagatgagcggcggctcctggccgcgggaccgtgagacgggttcgtggccggccatttagggggacgctgcgaccaccgcctgcgcccctccggactggttccttgggccccggaagctcgcggcgggccctgcgggaggcggcatgctcccgcggaggctgctggccgcctggctggcggggacgcggggcgggggcctgctggcgcttctggccaatcagtgccgcttcgtcacgggcctgcgcgtgcggcgcgcgcagcagatcgcgcagctctacggccgcctctactccgagagctcacgccgcgttctcctcggccgcctctggcgccggctgcacggccgtcctggccatgcctctgccttgatggcggcgttagccggcgtcttcgtttgggacgaggagaggatccaggaggaggagttgcagagatctattaatgagatgaagcggttggaagaaatgtcaaatatgtttcagagctctggagtccagcaccaccctccagaaccaaaagcccaaacagaagggaatgaagattcagagggcaaagagcaacgttgggaaatggtgatggataagaaacactttaagctgtggcggcgcccaattacaggcacccacctttaccagtaccgagtttttggaacctacacagatgtgacacctcggcagttcttcaatgttcagctggacacagagtatagaaaaaaatgggatgccctggtaatcaagctggaggtgattgagagggatgtggttagtggttccgaggttcttcactgggtaacccattttccttatccaatgtactcacgggattatgtttatgttcggcggtatagtgtggatcaggaaaacaacatgatggtgttggtgtcgcgtgctgtggagcatccgagtgtgccagagtctccagaattcgtcagggtcagatcatatgaatcccaaatggttatccgtccccacaagtcatttgatgagaatggctttgactacttactaacatacagtgacaatccccaaacggtgtttcctcgctactgtgttagttggatggtttccagtggcatgccagatttcctggagaagctgcacatggccactctgaaagccaagaatatggagattaaagtaaaggactacatctcagctaagcctctggaaatgagtagtgaagccaaggccaccagccagtcctctgagcgaaagaacgagggcagctgtggccctgctcggattgagtatgcttgacaggctttgggataagaagggacaaggtgcttctagccctgtctcagtccgttatcactctgctgtagaagggggacatgccacatgtattagaaggcatctgctgtaacttccagtgcaagataattcaataactgatgtcccatttcattcagagcccttattgctcttatcaaaacagaagaaggctacatttgtgggagtgttgtcatattctcaggccaactgttttgaaattcggtatctcactgagctaatctggaacaaacctctcacctcaggccagaaggggatgacctccatttgcttctctgagtagtttcctctgctgacattccaaatcccaccatcgattgtgcagcgctttggatttccttcagttctccaggtccacctggaaagtatagttggccagttgagtctctcaaatgaggggctactgggagtgctcttggtaacaatcatgatgtgaatgggtgtgaacgatacttggctatgttaagtgccttgtccgcaccttgcttttatctctagagacatgaagttattattaattttttttttttttaagtagagatggagtttcactctgtttcccaggctggtcttgaactcctgggccatgcctggccagggacatgaatttgtacaaagaaatttccctccctgcctgcacaatatcacccattgactcaccttatccaaagcaagtttcctgtgaatcggccagttcttctatattcattggatcattgcctccttcctaaccttccccatttaccaagaacactgggagactaatccttttagatagtagctttttgatgctcaaaacatcacatttaaatttagtttaaaaattttttaacttttgtgtcaaataggagttgaggaattgagcaggattctaccctagtccgattgtatagaaaacaccattttgattcaggtattatttttcatatttcaggtttgacttgttcttttcagaaggctaaagtcagaggaatgggggctgggccactcccttggagctctcagatctacagacaagctgtgtgaatgcatagatgtaatcttgtctcaaatactaatacagtggagatttggtttatgttaccattaagttcctctaaaaagtttttcttcctctcttcagagccaaaataaaagtgaactacactgttcagataaggtcacaatctgatgctgtcagtttgaccgagctggttttgcttatggtcatgctgcaatttgttagaataatagggatcaagttttaaatcctcctccttcccttttttctggagtcttgagggccagagtttttgtttttgtttttgtttttgttttcctgcttgctactgttttgtggtgttgaaaagtggtttaaacctgagactaacttaaacacttccttgaccttcttgttgcctgttcatttttgtgccaaggaagtagctgccccagtgtatgtcttgccttctccgcgtcattgttggaagaggagagatgcatcgagcagtcccagctgcttttcatttattacttcttctttccaggacctgacagaagtcagggaagagtccctgggttatgtccaaacttagcacctgcaattgttgggatgtggatggatgtgtgcataagagagagagagaatatgtgtgtgtgtgtgtgcgtctgcgagcgcacacacatgcacaagtgcgaaggagttgcggttgctccatgttctgacttagggcaatttgattctgcacttggggtctgtctgtacagttactcatgtcattgtaatgatttcactcctaactgtgacatttttatcaaatgtgtgaataaatacataaagattggtacaaaaaaaa

SEQ ID NO: 6641 - DNA, 1193 bp, Homo sapiens
ggggccggcacctcccggcagcagcggcagctgagactcacggtcaagctacggcgaggagtgggtggctgaagccatactattttatagaattaatggaaagcagaaaagacatcacaaaccaagaagaaatttggaaaatgaagcctaggagaaatttagaagacaacgattatttgcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggtacatggtaggatcaacttcctgaccttgtgacagatcctgccagtaacatgagaggaaatgagaacgaggctttggagcacagcattggattgctcatgcagaacaccacccagtgccctttccctctgccacaatgaacagccatgctgcaggtgacggctgctctgtcaacatggatccggcagggcagatgagtggatcccccagcggactcatgagagagcaaacaaaaagtccatatgtgttgtgctaatccactgagattgtgttggttgttacggagcctaacctagcctatcccgacacgaggatcagacatgataatcaaatgtgtttataaagtgttggatggaaatattctgacaacattaaaagactctacccaaggaa

SEQ ID NO: 6642 - DNA, 1004 bp, Homo sapiens
tcgcgctctggaggctcaggcgccgcgtggggccggcacctcccggcagcagcggcagctgagactcacggtcaagctacggcgaggagtggggttgaccagaagactgggcacatcattaattcagcacaactcaccattcccactggaaacatactggcaattcacatcttccaaacaaggaccaacctcttactccaaaagaaaaatggtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcag

SEQ ID NO: 6643 - DNA, 1515 bp, Homo sapiens
aatatgcccccgggtaatcttatacacgctgaagtctgagaaccactgctctagagaaatgcacaaacgttccttagtggagattaaacaaaaggcgaggggttggagggcgcgaaacggacctcaagggcagggcagacggcatttgagaggaaactgggagaggccggagtgcgacttggggagtcttagcctccaaggacgttcccgaaccctgcggacgcggggcgccagcaggtggcgctggacgcgcaactgacaaggaggcggggcctgcagcaggcttggaggcttcgcgctctggaggctcaggcgccgcgtggggccggcacctcccggcagcagcggcagctgagactcacggtcaagctacggcgaggagtgggtggctgaagccatactattttatagaattaatggaaagcagaaaagacatcacaaaccaagaagaaatttggaaaatgaagcctaggagaaatttagaagacaacgattatttgcatgaggacacgggagagaccagcatgctaaaaagacctgtgcttttgcatttgcagcaaacagcccatgctgatgaatttgactgcccttcagaacttcagcacgcacaggaactctttccacagtggcacttgccaattaaaatagctgctgttatggcatctctgacttttctttacactcttctgagggaagtaattcaccctttagcaacttcccatcaacaatatttttataaaattccaatcctggtcatcaacaaagtcttgccaatggtttccatcactctcttggcattggtttacctaccaggtgtgatagcagcaattgtccaagttcataatggaaccaagtataagaagtttccacattggttggataagtggatgttaacaagaaagcagtttgggcttctcagtttgttttttgctgtactgcatgcaatttatactctgtcttacgcaatgaggcgatcctacagatacaagttgctaaactgggcatatcaacaggtccaacaaaataaagaagatgcctggattgagcatgatgtttggagaatggagatttatgtgtctctgggaattgtgggactggcaatactggctctgttggctgtgacatctattccatctgtgagtgactctttgacatggagagaatttcactatattcaggctatactgactggaagcctggtagctttgtgcaactttcaggccactaaactggccaagacacaactggtaggcacaccaaatttctggcaggagcagcagtgtggaatccatttcccaccaccttccaagactaggagttatatatacttcattttatcagcagccagcccttcaaagggaaatgttagctctcacatgtttcagcttcatctagaaaatctcaataaaaaagacaagttattgctgatcatctttcagatttaagcatgcatgaaagtgagaaccttgttccctgctcatacatcttacatacttgcagaccagaccatggtag

SEQ ID NO: 6644 - DNA, 1995 bp, Homo sapiens
agccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaatacacagcacatccagaaagaaggaagagctctcaatcaagaggcagcgtgtgagatgcttcgtgaatggcatcaagggcatatattgaaagtcacccttcccggattacacattttagctttgttacatactcattgtaaccactccgaaaagtgctgcttgatgctgcgtgctctttctgtgtccctggaggtattctgaaggtcagaagagagatatacaacagcgaggcttggtgataacgtatagaataacagacggggactccacacccaggccttttttaacggtgtgaagcatagacagagctgcagtctgtgctaacattaggttatttattgattcaatcagttgacacaaggaggcagctacggggaggtaaaatatggtcctaaaatcaaaaagatttcagttttgtcattctgtctctgagattctatttccacatctagagcagggtaataatgatacctaccttacaaaattattgggagaatacattagttaatatatgtgaaagtatggaggagatgtgcaataaatatttgtgttattaactacacatacagcactctataggagatattccatttataaaaactttaggttctaaaaacctgtacacgttgattatttttgtaagtcaaaagtgattaagaggagtttaagctatcatttccagatgtatttctataaataaaaacataagtatattcagttgatttggggtggagagttccatagatgtctgttaggtccgcttggtccagagctgagttcaagtcctgaatatccttgttaattttctgtcttgttgatctgtctaatattgacagtggggtattaaagtctcccactattattatatgggagtctaagtctccttgtaggtctctaagaacttgctttatgaatctgggtgctcctgtattaggtgcatacatatttaggatagttagctcttcttgctgcattgatcccattaccattatataatgcccttctttgtcttttttgatctttgttggtttaaagtctgttttattagagactaggattgcaacccctgctatttttttttttttttttgcttgataaatattcctgtatccctttattttgagcctatatgtgtctttgcacgtgaggtgggtctcctgaatacagcacaccgatgggttttgactcta

SEQ ID NO: 6645 - DNA, 841 bp, Homo sapiens
cgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccaggcagcagcagaagtggtcctgacccagatgccctgacagcttttcctggtgtgattttggaagttaacccttgaacagaatgggtttgaactgcgcagcttcacttaaatgcatggattttcttctgcctccaccacctctgagacagcaagatcagcccctcctcctctcagcctactcaatgcaaagaagacaaggatgaagacctttatgatgatccacttccacttaatgaatagtaaatatattttctcttctt

SEQ ID NO: 6646 - DNA, 3101 bp, Homo sapiens
attttcacagctcctcctccccggccgcgcgcccctcccgccccgcgcgcgcctcctctttctcgcggccgagttcagcccgggcagccatatgggggatacgccagcaacagacgccggccgccaagatctgcatccctaggccacgctaagaccctggggaagagcgcaggagcccgggagaagggctggaaggaggggactggacgtgcggagaattcccccctaaaaggcagaagcccccgcccccaccctcgagctccgctcgggcagagcgcctgcctgcctgccgctgctgcgggcgcccacctcgcccagccatgccaggcccggccaccgacgcggggaagatccctttctgcgacgccaaggaagaaatccgtgccgggctcgaaagctctgagggcggcggcggcccggagaggccaggcgcgcgcgggcagcggcagaacatcgtctggaggaatgtcgtcctgatgagcttgctccacttgggggccgtgtactccctggtgctcatccccaaagccaagccactcactctgctctgggcctacttctgcttcctcctggccgctctgggtgtgacagctggtgcccatcgcttgtggagccacaggtcctaccgggccaagctgcctctgaggatatttctggctgtcgccaactccatggctttccagaatgacatcttcgagtggtccagggaccaccgagcccaccacaagtactcagagacggatgctgacccccacaatgcccgccggggcttcttcttctcccatattgggtggctgtttgttcgcaagcatcgagatgttattgagaaggggagaaagcttgacgtcactgacctgcttgctgatcctgtggtccggatccagagaaagtactataagatctccgtggtgctcatgtgctttgtggtccccacgctggtgccctggtacatctggggagagagtctgtggaattcctacttcttggcctctattctccgctataccatctcactcaacatcagctggctggtcaacagcgccgcccacatgtatggaaaccggccctatgacaagcacatcagccctcggcagaacccactcgtcgctctgggtgccattggtgaaggcttccataattaccatcacacctttccctttgactactctgcgagtgaatttggcttaaattttaacccaaccacctggttcattgatttcatgtgctggctggggctggccactgaccgcaaacgggcaaccaagccgatgatcgaggcccggaaggccaggactggagacagcagtgcttgaacttggaacagccatcccacatgtctgccgttgcaacctcggttcatggctttggttacaatagctctcttgtacattggatcgtgggagggggcagagggtggggaaggaacgagtcaatgtggtttgggaatgtttttgtttatctcaaaataatgttgaaatacaattatcaatgaaaaaactttcgtttttttttttgtttgttttgtttttgagacagagtctcactctgtcacccaggctggagtgcagtggcgcagtctcggctcactgcagcctccacctacctggttcaagcaattctcctgcctcagcctcctgagtagctgagattacaggagcctgccaccacacccagctaatttttttgtatttttagtagagacagggtttcatcatgttggccagactggcctcgaattcctgacctcaggcaatccacccgcctcggcctcccaaagagctgggattacaggcgtgagccaccgcaccctgccgaaaaaaacttttttttttttgagacggaggctcgctctgtcccccaggctggagtgcagtggcgagatctcagctcactgcaagctccgcctcccgggttcacgccattctcctgcctcagcctcccgagtagctgggagccagcgcgcccagcctaaaaaacttttcaagtcaatattactacgatttaacattagagtgtggacatgtgatttaatcgctatagctaaaatacgtcaaatatacgttgtcatgtgcttgaacatgatgctaaccctgacaggatgaaggaaagtaatattctttcagtgtagttcaggagagcatttgttttcttttctaccaattaacccatcattgcttttaaacaaccatctgaaggagcagagaggcagggtagaagacagaagggggatctatgtggtaactaaagaatgtttctgttttgttaattattgtgtgtgtgtggttttattgtttgcttaagagaatcaaaaactgaaaaaaatgagaatacaggaaatggctcttgtttatttttttgctgtgtttacagcttgttaatgctctactgtctttgtttcaagagagatttgttcactgcccagctcgttttgtgtcctgagccctatggccagcccaccttataaatcatgcctgtttagatgtttgattttgttctgtttgctattgttatcttaaaggtgtataactctgacatgccagacatcaaattaagctcaaattaagctctcgtttaaatgtttaagcacctaatttatattctaattgatcccagccactgatgcatgtactttagctacttctgctaaataagcatattaattttccacatcagaccatcagatcttgagaaccaacagttatctagaattccgtgtctactaatgtttcacctgcatgcagccttcattaattttgtagcaaaatataaagtgatcattatgtagcttctggattaaaaaaatttgtgtgtgaagttgctttgtaaagtgcatgtggaattaatgggacagtgtgccctttgtgttagatgttagagcaaaagaaagggcttatagtgttagtattggagcactttgaagatagatattttcagaaaagatgtaggatttaaaagttaaattttaaattttagaaaaagatatgatggcaattggaaatagtcacaatgaagttcttcatccagtaggtgtttaacagtgttattttgccactggtaatgtgtaaactgtgagtgatttacaataaatgattatgaattca

SEQ ID NO: 6647 - DNA, 3010 bp, Homo sapiens
gactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaa

SEQ ID NO: 6648 - DNA, 870 bp, Homo sapiens
agggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagag

SEQ ID NO: 6649 - DNA, 1511 bp, Homo sapiens
attcccggcggctccgggtttggcaacgaggacgggggagtgcgactgcgtctcgggcagcatggccgagaagcggcacacacgggactccgaagcccagcggctccccgactccttcaaggaaacttgaactccaagcatttggcctcacatttcagaagattatccttgaagatacaaccaataaagtcctaaagtctcagacaatgaaaactatactgaacttgtggtccagttaaagtgagcactatgacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctga

SEQ ID NO: 6650 - DNA, 3759 bp, Homo sapiens
agagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 6651 - DNA, 1595 bp, Homo sapiens
gcctgtctgtttcttatacctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 6652 - DNA, 3534 bp, Homo sapiens
tgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacaggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctg

SEQ ID NO: 6653 - DNA, 3824 bp, Homo sapiens
ggactttgggactggacagacctggtcacagtctaggttctacatcttactggtcgagcaactttagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 6654 - DNA, 3821 bp, Homo sapiens
agaagatgcgctggagggaagagaacggagcgtcggacaccagaaaaactttgggggattcgggagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagattcatcgaagcaagaacaaatggaaattctatttgaaagatggtgttatgtgttttggagggagagactatgtatttgcaaaagccattggtgatgcagagtggtaaaccttgtgagctcagtacatctattttgtgaacatcagttggattatattgcatattgtgaattcatttttattttgaatatagtccagcacagagctgttcaaatttttagttcactgtatggaatttaataaaattataattcagatgcagatacaatt

SEQ ID NO: 6655 - DNA, 3772 bp, Homo sapiens
agaagatgcgctggagggaagagaacggagcgtcggacaccagaaaaactttgggggattcgggagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccagcctaaactctacagatctgtaattgaagatgtaattgaaggagttcggaatctatttgctgaagaaggtatagaggaacaagttttaaaagacttgaagcagctctgggaaaccaaggttttgcagtctaaagcaacagaagacttcttcagaaatagcatccaatcacctctgtttactcttcagttgccgcacagcttgcaccaaacattgcaatcgtcaacagcatcattagttattcctgctggtagaactcttccaagttttaccacagcagaactgggcacttcaaactccagtgcaaactttacttttcctggttatcccattcatgtaccagcaggtgtgacactacagactgtatctggtcacctttataaagtcaatgtaccaattatggtgacagagacttctggaagagcaggtattcttcagcatccaattcagcaagtatttcaacagcttggccagccttcagtaatacaaactagtgttccacaattgaatccatggtctcttcaagcaactactgaaaaatcacagagaattgaaaccgtgctacagcaacccgcaattctaccttctgggccagtagataggaaacacttagaaaatgccaccagtgatatacttgtatctcctggaaatgagcataaaatcgtgcctgaagctttgttgtgtcatcaggaaagttctcactatatcagtcttccaggtgttgtattttctccacaggtctctcaaacaaattctaatgtggagtcagtgctcagtggttcagctagcatggctcaaaatctgcatgatgagtccctctccacaagccctcatggggctctccaccagcacgtgactgatattcagcttcatattcttaaaaataggatgtatggatgtgattctgtaaagcaaccaagaaatatagaggaacccagcaacatacctgtatcagagaaggattctaattctcaggtggatttaagcattcgggttactgatgatgatattggtgaaataattcaagtagatggaagcggtgatacatcttccaatgaagaaataggaagtacaagagatgcagatgagaatgaatttctagggaatattgacgggggagatctgaaggtacctgaagaagaagctgacagtatttcaaatgaggattcagccacaaacagtagtgataatgaagaccctcaagtaaacattgtagaagaggaccctttaaattctggagatgatgttagtgaacaggatgtgccagacctgtttgacacggataatgttattgtctgtcagtatgataagcagggagataccagggttcgtcatgggcagcaatgactacgatggacaagaagatagaggccctaatcctaattttctgagcaccatggaagccccctggattctagggagaccttgaggagaaagaagactcctgtaaatgcctgacattgaaattcctgcaagtctaggagcatgtgaactcaaaatggaaattaatttgatttaataaaaataaaga

SEQ ID NO: 6656 - DNA, 5802 bp, Homo sapiens
gatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaactattcttactgtgctgtgaatttatatcttcttctgcaagacctggggctatttttttttcttaaggtatgaaatcaatttcaataaccttaaacaattgaccctctgtcaggcatatgtcaggctccactcttaaggagtcagtgaccatgacctctttgcatatcctggaaaaatgacatcatcaaagtatagttgataatgttataaaggatgattttaaaaatagggtataatcatgactcacaaagatatgaggctgggtgtggtggctcacgcctgtaatcccagctctttgggaggctgaagcgggtggatcatgaggtcagaagatcaagaccatactggctaacacggtgaaaccccgtctctact

SEQ ID NO: 6657 - DNA, 5511 bp, Homo sapiens
ggtgtggctggctgcggccagaatcggagccccaaccgcgctgccgagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaact

SEQ ID NO: 6658 - DNA, 5614 bp, Homo sapiens
ggccagaatcggagccccaaccgcgctgccgctcggaccttagcctgtgcctgcagcccggagtcccctcctgccctggaaggcaaggagccaggccacggggccacagccgcgggggccaccacactggcccaaatatttcctgcagagtcaacctatttgatttcttgacaagaccacaatctgatcccaaagatgtgctccacaaatccaggcaaatgggtcacctttgatgatgatcctgctgttcaatcttctcaaaagtcaaagaattttcctctggagaatcaaggtgtctgtagaccaaatggactgaagctgaaccttcctggcctcagggaatttcccagtggatcttcctccaccagcagcactcctctctcctcccccattgtagatttttatttcagtccaggacctccaagtaactctcctctttctacacctaccaaagacttcccaggttttcctggcatccccaaagcagggactcatgtgctttatcctattccagaatcatcttcagacagcccactcgcaatatcaggaggagaatcttccttactgcctaccagaccaacatgtttatcccatgccttgttacccagtgaccactcatgtacacatccaactcccaaagtaggtcttccagatgaagttaatcctcaacaggctgaaagcctaggattccaaagtgatgatctcccccagtttcagtattttcgagaggactgtgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaattttgcagatgtattatgaacagggattagaaaaaccatttaaagagatacagcttgatccatattgtaggctttctgaacccaaggttgagaacttcagtgtagcaggaaaaatccacactgtgaagattgaacatgtgtcttacacagaaaaaaggaaataccattctaagacagaagtagttcatgaacctgacatagagcagatgctgaagttggggtccacatcgtaccatgacttccttgactttctgactactgtggaggaggagctgatgaagttgccagctgtttcaaaaccaaaaaagaactacgaggagcaagaaatttccttggaaattgtggacaacttttggggtaaagtcacaaaagaaggaaaatttgttgaaagtgctgtgataactcaaatttattgcctctgctttgtgaatgggaacctggaatgctttttaaccttgaatgaccttgagttgccgaagcgagatgaatcctattatgagaaggactcagaaaaaaaggggattgatattcttgactaccattttcataagtgtgtgaatgtacaagaatttgagcaatcaagaatcattaagtttgtacctctggatgcctgccggtttgagctgatgcgtttcaagactttgtataatggggataatcttcccttttccttgaagtctgtagtggttgtccagggagcatacgtggaacttcaggcttttgtcaacatggcctcattggcgcagaggtcatcctatgctggttccttaaggtcctgtgacaatataaggatacactttcctgtcccatcgcagtggatcaaggccctttggaccatgaacctccagaggcagaagtctctgaaagctaaaatgaaccgccgagcatgtctggggagtttacaggaacttgaatctgaacctgtcattcaagtcactgtggggtcagcaaaatatgagagtgcctaccaggcagtggtatggaagatagatcggcttccagacaaaaattcaagtctagatcatccccattgtctgtcatacaaattagagcttggatcagaccaagaaattccctctgattggtatccatttgctactgttcagttttccgtgcctgacacctgtgcctcaaggacagaggtcaggtctctgggagtggagagtgatgtccagccacagaaacatgttcagcagcgagcttgctacaacatccaggttgaaatagaaaagaagtggattaaaatcgatggagaagacccagataaaattggtgactgcataactcagtaggagtagcaagagtttatgatgacagcccacttgtcaaatatgtaattcaccgaaaccacaccaagtcctgctactgtagagtggaaatgacttctgaatagcggttttaggacaggtctgatggctgtgtttagagaagtttagacctaaaaccgaacaatctgtattttttgcttttcatgtgtttttgtcctaggggttcgatctaaaatgtttctataattcgtgtgatgttttgcttcctattgaaactcaaaggcactgttactcgttgtgtgaccccgcagccagtatgatttttgattactcagtggctgactgttttgctctctggattactgaggtgccgtcttcatttcttcccatctcttcttgctgcttagtgtctgtactagagggtaagggaatcaaaggagacataaaccaaaatagttaattttccctctttcttgcctctgaaatgtggctaggtgtagaatgatgttgaaaccacaggctaaaatgtagatctggaagtatctgtgcttttgaattacttatttacctgtcctcttaccgttggtaaataataattggctatatttggtacctgtctctctcctactgtattgtcattttcaaaatgtgtttgttttctggcgcgtgctgcaaagaagctatttctgttgtcctacatattttagtataaatcactaagacatatttcctttcacttggcaggattcctttcaaaatggaatctgagtattagacactagttaacatatttgtgtatattaaatatgaatttttaaaatttataaatactattttccaaaagtacagactctaaggacatattttgataaagtattatttgtaatgaacacaagcctctcttgagtagaagtctaaatcacattatgattattttatactagttctgctatcatgctgttttatgctaattctgcttattttagagtatttttcattaaaaggtgagcaaagtgaaagatacttggtattttacccagatttctaagtggcaacatttttattcttcagagtcaggtaaatgactataatagtttggtttctaatgaaaagtcaatagcattagcagttataattctgtttataatttcctttcagcatttacagtgaaaagtgagaattttaaaatttatgaaatctatattccaggtattgtttttagtctgaaaaacaaactcccccatgtggtattaatataccttcaatttatgttgagtcttaaacataattaggagatatttttctctatttgctagatttgttttgagtcaaaactgatttagtgttcttccaaacaacatttatgtgttggcctacagagtttatttcatgtgttttttttaatatttaatattatattacattcattgaaatctgttcaaaaacagattaagacaaacatttatgatggtctgtatcaatcagcagattttattgcttttcattattttactgtaaaggcaaagaatgcaataggtgatggttggttgaaaggaattgttattgctgtttttattttttactttttttgagacagagtctcactctgttgcccagcctggagtgcagtgtgtcatcttggctcactgcaacctccgcctcctgggttcaagggattctcctgcctcagcctccaactagctgggattacaggcacaagccaccatgcctggctaaaattcttttgtatttttactacagacggagtttccccatgttggccgggctagtctcgaactcctgacctcaggtgatccaccagcctcggcctcccaaagttctgggattaaatgcgtgagccaccatgcccggccgctattgctctttttaacttcatttgatgccttgcttataatatcatatgcttgaggctcactgttgatgtagagtagggcaaatctgtgtgtgtatgtcattaaaaaaattctaccatctttctttatcatctggtgtgggcgcactctacagtgacttcagtctgctcagaacgaatgtggaggccggccgaaactgatgctgcccacagtcccagtgaagttaggtgggttaattactgccattcctttctaagtgtgttttatggcatcctgcccacaaagaactcacagtctgattaggatgaacttaatgactatttacacctcaaaatatattcagcaaagggttcacttagttgcccctcatgcttcacaggttgactagtatctgtgggtacctccctgcccaggttattcactcacaagccaccgggccttcaggacatctcaagattcagtcttgacaatataatagcaaaagctggactaaagcccaaatggattgtctgtggcaatgcagaagctgatagcattaacagcagggtgttacagcataattgttaattcgcacatctattaggatccttaaatattcattacttaatgttaaattaacattctgtgtagggaggggaggcttattcaattcttctgacctcagaactggcagaaggtcagatgtgactacagaactctaggtgaaaaatcaggtagggttcaaattaagtagaactgcccttgccggaatagtgatcttcaaaaaacccttgcttttaggggagggaagcggggaaggaaaggaatgagggaggaaatattcctttctagcattcattttgcttagatcactccattgtgagtttgaccattttggagtcaaatgagcagacttccaaggagttgaccagtttgtgactagtctggtcacctttccagttacaggatcatattaactgtgtaaatgaattcatgggtagatgatttgtgcagatctgaatttaagaacatttcctttttctgtgggaatcacaagagtttatccactaaaaaaagatatgtaaaaaagatactttccagcacataaataaaggctggaattttacaacctgatgtatatattagacagttctaggatgttagttcccttcattccagagctatgcttgtgatacagccccttttcttataaagtcagttagaaggacttccttaacaatgactattataatgtcttacttaaaatacagttttgtattctgtcaatgcaaatataagacaggttgagccttaatcatgtaacaaaatattttgtagattacatattgatttttcaaaaattaaaaatgtatttcaaacta

SEQ ID NO: 6659 - DNA, 2977 bp, Homo sapiens
cagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccaggtagccttgggaagcatctggctaatgcttccaactccatttgttcaccccactaccctccccctcttattccttttagccatgcttactatgttcgcctggtaacctcttactgccttagaggaagttcaccatacatagctgtgggtgcgtctgctctgat

SEQ ID NO: 6660 - DNA, 2964 bp, Homo sapiens
cagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtga

SEQ ID NO: 6661 - DNA, 439 bp, Homo sapiens
ctagcgccgctgtgccccctggcgcccccgagcctgcctggtcgagccacgcggaggcgcggcgtttccaccagccgcgggcgtcccggggtgggggaggacgaggggactctgcttaaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactt

SEQ ID NO: 6662 - DNA, 603 bp, Homo sapiens
gagtctggagccggcgtcggcgctgcggccgggagggatcgtggcgagagcagtgcggccgggtgggtatcccgcggccagagaagccggctttgccgcggcgacctttcggcggacgccggggaccctgcggaccgcggcgcaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctc

SEQ ID NO: 6663 - DNA, 4302 bp, Homo sapiens
cttggctggtcacagcacagtgctcctgggcccaggggctgtgatctcctgtcatttggttgccattttcctgtgaagagggtagagaatatgcacccagtcaggaaaacaactcacgaggcaaaaaagtacatctcgtggatggagcagggcgaagtggttacaagtacagactctggagccagactgcctgggtttgaattgtgcggtttcagatttctgcctggcagattaaccaacggcaagagaggctgatctgtctacattctgagtactgcccttggcaagacacctagaacagaccctggacccaagtctaccgtactaccatacccctactccagcccaccccagacagtattctggggttcacctgaggtcagcagtgtgaagatgaccagtgcctttttagcatgacgactttggaccatgtgattgccacccaccagtcagaatgggtctccttcaatgaagagccaccctttcctgcccactcgcaggggggcacggaagagcacctcccaggactgtcatcttccccagaccagtccgagagctcctccggggagaaccatgtggtggatggaggctctcaagaccattcccactcggagcaggatgactcctctgaaaagatgggcctcatctctgaagcagcttccccacctgggagccctgagcagcccccacctgacctggcctcggccatcagcaactgggttcagtttgaagatgacacaccctgggccagcacatctccacctcatcaggaaacagctgagacagccctaccattgaccatgccctgctggacatgcccttcctttgactccctggggagatgccctctgacttctgagagcagctggaccacccattctgaagacaccagcagtcctagctttggatgttcgtatacagatctgcagctcatcaatgctgaggagcagacgagtggccaggcttctggggctgactcaactgacaattcctcctcgcttcaagaagatgaagaagtagagatggaggccatcagctggcaggccagcagtccagccatgaatgggcaccctgcccctccagtgacctctgctcgttttcccagctgggtcacctttgatgacaatgaagtcagctgccctttaccaccagtcacctctcctctgaagccaaatacaccaccaagtgcatctgtgatcccagatgtaccttataattcaatgggatcatttaagaagagggaccgtcccaagagcactttgatgaacttctccaaagttcagaagctggatatttcctctttaaaccgcacgccttctgtaactgaggcttcaccttggagggcaaccaaccctttcctgaatgagactctgcaggatgtacagccctcccctatcaaccctttcagtgctttctttgaggagcaggagaggcgctcccaaaacagttccatttccagtaccacgggcaaaagccaaagagattccctcattgtcatctaccaggatgccatcagttttgatgattcaagcaaaacccagtcacactctgatgctgttgaaaaactcaaacaactccaaattgatgaccctgatcactttggcagtgcaactctacctgatgatgacccagtagcctggattgaactagatgctcacccgcctggatcagcacggtcccagcctcgtgacgggtggccaatgatgttgaggatccctgagaagaaaaacatcatgtcctccaggcactggggaccgatcttcgtcaaactgacagacactggttacctgcagctgtattatgagcagggcctagaaaaaccattccgtgagttcaagctggagatctgtcatgagatttcagaaccccggcttcaaaactatgatgagaatggcagaatccacagcttgcggatagaccgtgtcacctataaagagaagaagaaataccagcccaaacctgctgtggcccacacagcagagagggaacaggtgattaagctgggcaccaccaattacgatgacttcctgagtttcatccatgcagttcaggaccgtctcatggatctgccagtgttgtcaatggacttgagcacagttggcctcaactaccttgaagaggagattacagtggatgtcagagatgaattctctggcattgtgagcaaaggagacaaccagattctccagcaccatgtcttgacacggatccacatcctgagtttcctgtctgggctcgcagagtgccgcctgggcctcaatgacatcctcgtcaaagggaatgaaatagttttgaggcaggacatcatgcccaccaccaccacaaagtggatcaagctccatgagtgccgtttccatgggtgtgtggatgaggatgttttccacaactcacgggtcattctgttcaaccctttggatgcgtgccggtttgagctaatgcggttcaggacagtgtttgctgagaagaccttgcctttcacactcaggacggccacaagtgtcaatggggcagaggtggaggtgcagagctggctgaggatgtcaactggcttctccgccaatcgtgaccccctcactcaggttccctgtgagaatgtgatgatccgttaccctgtgcccagtgagtgggtgaaaaacttccgcagggaaagtgtcctgggggaaaagtctttgaaagccaaagtgaaccggggggcaagttttggctccactagtgtttctggctctgagcctgtcatgagagtaactctgggaactgccaagtacgagcatgccttcaactccattgtgtggaggataaaccgactgccggacaaaaactcagcttccggtcacccacactgtttcttttgccaccttgaactcggctctgaccgggaagtgccttccagatttgccaatcacgtgaatgtcgagttcagcatgcccacaacttctgcctccaaagccagcgtgagatctatctctgtagaagacaagactgacgtcaggaagtgggtcaattattctgcacactacagctaccagacaacagaaacagacaaccttccaaatcctctatattgcagttgccttccacacacagatttaaaaagaggatcaaagagggtggtgaagatcaggtggaatgcttctttggaagttccactggcatcatctatcagaacaatggtgtgagcatgaagaggcacagacaggtctccaaaatagatgttaggatttgggtgctacctgacacagaagtaggtctaaccctccaagtactggggatgataggataatcaatgaggtatatatatatttgtcattttgtataaaatattgtgaaaattgaaggaggacactcagtaaacatcctgggactatttgtaagttatggcaaaaccagatgagagaaaagggacagtcccctctgtatcctcgttgtctcttagtaacatcaaattgtagttaaaaaaattttaaactatgtacaagctacaaaatagcatctctttcatggtatgtttgagtgtgtaattttagtttcttttctggttgtatttgtggtagtcagatgtgttggattgattccaactggacagagtaaggaattccagcatcctcttcctgcttgctcgtgttaccccacagatcaaaccctcaattctagttggggatgctgtctagccccacaccatgactgaagccttaagcactgttgcgcctccatgtgctttggatcagcaaccccagtggtattctaccagagcattgtgggaaagcagatgtatagtcaggtcccaacagcaaattgttgggtgtgagagttctaaagtataggggtgagggaagagaaggatatgaactcctctgaccttaagccagcattcatttaacttttatgtctacttaacaagagaacctggagaaaactaccgtattcaagagattaatcaaaatcagtgttttagccaggcgatgacagagaagcaccattcctcaccctccattcttgtaatgtctgtaataaatttcagtgcgtcaggatggatgaacccaagatccagtgaatgattcagctgttccaagccttacattttccatcattcatcatccattctcattcagtgtaacctcttgcactattgtggttaattttatgtaaaaccagtttatgtttttttttttttaatatgtgcctatgtaataaagtctacacactggctatctctgtagaggtgaggttttgtttttagttgttctactgattatatccttttctgagctatgaaaatgaattattaataaaaaatttttgaac

SEQ ID NO: 6664 - DNA, 2396 bp, Homo sapiens
attagctgggacaaggtgaaacggcttcgacagagtcccaacaagatgacaactccagcaagatgcagtgctggtctgggaggtgtttgggtgggcgctgggctgtgcaccagagggttatcaaagcccagttccttcccgtcctgttctcaccacggcccgggcaggatgtggcctttgcttctgcagttgaagctgggtctctaccatatcaaggctcagctgggagagtcggatccagccagtgggtgcagaggcctgggcatggtgcacaccatgcttgtttctgtttctgtggcagaaacttagtcaaatccctggaggtgggattgtgcaatctgcttgtgtgtccagaagccaggaccaggggaggatggctctggtggacaattcatcatctccaccattgacaggactggggagcccggaatgaaagtactgaggatgccgaggccctcacaggcaacattctagtgccccttgggaacaggaggttttggtaattcaggaaagacacacatgagagcaggaactaggggtggggtcaggacttgggcacgtgcaggcttggcaagtctgagaggactgtggcaaaggccaggacagggaaagggataaggaaggcctttgtcttatggagtgaggactttgtgaagagggtgattcatttcccagggctgctgtgacaaagggccacagccaggtggcttaaagcaacagaaacatgttccctctcagttgtggaggccagaagtctgagattgaggtgtgggcagggctgcgttctctccaaagccaccacggaggatccttcctcacctctcccagcttctggtggccatgggcagtccttggcttgaggtttctctgcccacgtcttcacagggtggccgtcctctgcatctgtgtctctgtatctccatggccttctcctcatgtctgtctcctcttcttataaggacacctgttgtaccagatgtatcagagtggagcccgccctgatggagtatgacctcatcctcacatctgcaaagaccctatttccaaataaacttgcattctcaagtactgcagttaggagtttaacatatcttttacagggacaaaattcaaccctcaacaagaggacagtggatattaggtaggaaggatggttgagaggcaaacctgtactgagccaggctgagtagctcagactgtgttccttaggccagtggctctcagtcctggctatttatcagaactacctaaaaagcttttgaagatgcagacatcagattctacccaaacctactgaatcagtcattgtaggatatgaaatatttaaagctccatgggtttctaatacttaccccaggttgagagccactgctctggctaatgaggacctcttgaaaggtttttatttcttgtggtatcagttttaggacagcttgcagctttgaacaaatatactataaataatattatcacataatattataacacaatatgaacacatatttatatgcattttctaagtttccatcctaaaaggtgaccctctgaattgagaagaatcctcaaggtgctatgtggccagccccatgctcggtgggaagactgcttatcttcttcatgtgctcttcctcgggatatgtagtacagggttgtggtccttctccaggagccagaactactcttggctccccgttgagtttgtggtctattaaaactccctcccacatcttttgcacacgaagggctataaatctaggttttccctctccaccacttgttcaattgattttttggagcctgaatgcaggccttgacttatatctctgtttaatttcatcttgtggtttcagccaagtgttctggcctgtcgaggccttctgtagtttcagtctgtcattttttgcgttagcgctgtctcataaatttgtcatctgcagattggatcaacacatcttctcgggcttcaccaaatcactgaaaaacctgccaccatgtcacaggacagacatatgatattcctccagagacggctctccttcggaaagcactctttgggaatgtagttcctaaatcagctgtcatattgaacaaacacccagtcaagccatattttattcttagagcactcttttgaaactttagtcatccaggaagtgctgcaaatgcacagttggtccttgatggacatgccaggaggagcaacgaggggagacaaggtgcccagggccatgaacacatcacttggtctgcaccaagagagttccagccacagataaagaatcttcattgccaactttgacctgaaagcaatgaatgggtcaactaagcaccatgtgttcattactgagaaataaattcaaagagctaacatgacaccatcttggaagccaaaagct

SEQ ID NO: 6665 - DNA, 3171 bp, Homo sapiens
aaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaactgc

SEQ ID NO: 6666 - DNA, 3934 bp, Homo sapiens
actcaccaccatcttggtagtgtgcaagactctgggacggcatgagaaaggcagaaagggagcaaaggagctggtggggtgtcacagggcctatgtatgaggcagatgtgagttctgcatccagttttgcaatttatccatttacctgcctgagacttggaaacacctactttatagtcctgattcaagtgttggcggatggaagggaggagactcctgaccctcagaatgacctaaatgacttcacaagggcccgtgtaacaccagtattgcagacccatgtgtcacaaattcaactagcacattgtttttctcccccttcttctatttctgtagaagatgaatccgcaggcaagaatgatggatgggtgaaagggagggggaatacgaaagcccagaggcggagacttcacttccgattgccacgctatatcaagaaagccaacagtctggcctttccgcaagccacaagaaaaggcagatcagactccccggctcctcgggtagttctcaaaggcaaagacaaaaataagaaactagtctgaagaaagagagtccctcgcttcttcagaactcacctgtcaagagcggcgtggacggcgccatgttgtcccggaaagagaaaccgctcgggtgagagttcaccagggccgaacccggcccctacacgtctcctcatgcgtggagacagcgaattggtgtttccggagccatcagcctcggggccaattcacttccggttacggagtgacgcggaaaaggcgcccaaacgcgcacgcgcaaatctagggcgacgcttgacagagcttgggagggtgcgcctgctttcgccctccttctccagcgggaggggcgcgcacttccgcggggcggagtccgtctagtgctgacgttggcagccgaacccaaagtagatcgaggcggcgggctgcacattcccgttgttgcgttgcgtttccttcctctttcactccgcgctcacggcggcggccaaagcggcggcgacggcggcgcgagaacgacccggcggccagttctcttcctcctgcgcacctgccccgctcggtcagtcagtcggcggccggcgcccggcttgtgctcagacctcgcgcttgcggcgcccaggcccagcggccgtagctagcgtctggcctgagaacctcggcgctccggcggcgcgggcaccacgagccgagcctcgcagcggctccagaggaggcaggcgagtgagcgagtccgaggggtggccggggcaggtggtggcgccgcgaagatggtcgccaagcaaaggatccgtatggccaacgagaagcacagcaagaacatcacccagcgcggcaacgtcgccaagacctcgagaaatgcccccgaagagaaggcgtctgtaggaccctggttattggctctcttcatttttgttgtctgtggttctgcaattttccagattattcaaagtatcaggatgggcatgtgaagtgactgaccttaagatgtttccattctcctgtgaattttaacttgaactcattcctgatgtttgataccctggttgaaaacaattcagtaaagcatcctgcctcagaatgactttcctatcatgcttcatgtgtcattccaaggtttcttcatgagtcattccaagttttctagtccataccacagtgccttgcaaaaaacaccacatgaataaagcaataaaatttgattgttaagatacagtagtggaccctacttattcagtcaattaagagtaagtttttttatgtggttattaaaacagtatgaacaattagtctaactctgcatagacagggtctagattttgttaacccaaatgtataactgcagttagcttaaattacaatttgaagtcttgtggtttttatatagctaggcactttattactcttttgaactgaaagcacactcccttataggttcatgtaactgtcctgtaataaggtgcttataaatggaacaactacacagcctagttttgccacaacctttagcatctaaaaagttttaaaagcttctaaatgtctaatataaagggagatgcttatagccacaacatctattttaccaatattgtttccattacactaccttggattttgcatgagtgagtatagtaacccaagatgccataaaaaaaaaacttgatcgttttctgacttaatcagttactgtggtttcactaaaagctaccgtggtggagtgaagtcagtcagggaaggtttgtttatgttacatttatttcaccagaactattttaatatatcaaaggggtttactatgccaaacaaaattctagggaaaaatactgctaaaaatggatgcctcatcagaacatgctgttgagtccaatgtgccataagacattttagcatgttaaatagcacttttaatagcaaaaaaaggcacatcaactgcgaagttatccttagtttgcaaatgctttttctagattaatgatttttcaatcattagggtactagacacatcagcctaaagtggcatctggaattgaatggatttactgataatgatcagtctttagtcttccctttgttatatgactttataggttatgattgatcaaatttacgttttactaatggtaagggtgagggtcatagggcaggttttgggttttctagtactgttgaaaactgcaagtattggctatttgtatacttagccataacttggtgaaaaaaaacctgagcagtgtctatgtattaatgcgttggaaagaaagctgcttgtgtttgctttgttaattgcctcaggatatttcttttaaaataagctgttttaagaggaacagaagggaaatctgctacctagtctatacacagcgtgaacctcacagggggcttctgataccctcaaacatggagaacagtaagggagcagagtggttaaggactttcaggaacttaactattctggaataaggaatgaatcaactgaccttgggccagcaggtttttaactaaattgttacttgcctttctcacccagttaatcagtctctgtacttgtttccctttttgaaacaagtgtcttggttaactaattctgttttatggttgtgctaaattcatagcaggtgccttattctttgcttttagtcaaaccattccatatcagaattttccttggtttactatagatatttggctttaagttgttgtttgtgttttttaatgtacaatgttctgataaatttgactgttaaattgctatagctagcaatcattttacatatgtaaaattgcattccctttgtatttcatgtgtaattcaccaattaagtgcagtttatattcaggttggattatgcatgtttaggtaaacgaaagctgtgtcttacttgatttattctttaaaaataaagttccctgaatatttgatgcttttcttctaaacggaaatgattttacagttatctgagtgtaccttttatagttagtagaaaatgattttaaagaatgtttagtattgtacttaaatggtatgcagaggcacagatgtaaggtttataactggaaataggtggtaagaaaaatatatagaaagcacaatgatttgaatatttttccacttaggatttcctaatctccttgtcatccaattcaagctcaagatgaagcacaattctttgatctccctttgccagttgaattttatagatcatctaatgttgagcacagtatgagaataaatattggggttgtcaacattactcagttactctttgtggtttaactctaacatttcaacaagttgtcaattaattgtatctgttgggttgtatataatgttgctcaaaataattaagtggacttccaaaaataagatttccattgtaacaggatgcattgtgatgggctttgacttacattaaagaaatgtggatagtcaa

SEQ ID NO: 6667 - DNA, 784 bp, Homo sapiens
gcctctctctggagtcggctagccggggctcggggagcggggtgcgcagggctcggggccacgccttgccacctgcagcgcccgggtgggccgcgggggcctcggcgggacgcgctcggccctgtcgcaggagctaacgcagggggaatccttgcaggtgggagcatttcagagcgcacaagccatggtggccaaacagcggatccggatggctaacgagaagcacagcaaaaacatcacccagagggggaacgtagccaaaaccctgaggccgcaagaggagaaatatcctgtgggaccatggctgttggcactgtttgtttttgttgtctgtggctcagctatctttcagatcattcagagcataaggatgggcatgtgagaaagccagggatttgacaccacctccctcccactggaggcgggaggacaacggaagcggtcagccagtttctgcgggaaacaagcaggccacacggaatagaaaaaaacgctcccccacttgttccctgatcacttcatcgtggatgtcagaccaaattgccttctcacaggacatcttggtgcatccgcgttctcaagcggaaaggacattttgcttttctgttggcaggattagtagccacgcgggtcgtccgcagcagtgctgtttttttggtttttcccttggtttcactaatgcgtgcatgtggccctctgaacgatcactggtttactttctatggatacaatctctcctccattgagaattgattttacaaataaatgtcttcgttcaacctta

SEQ ID NO: 6668 - DNA, 8168 bp, Homo sapiens
gcggccgccatggacgagcaggcgggtcccggcgtcttcttcagcaacaaccacccgggcgccggcggtgccaaggggctcgggcctctggcggaggctgccgcggccggcgacggggcggctgcggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtaccctagaagtcctctattaatccctgtaagaatctcctggaaacctggatgaaagagtttaatgccaaatattggctaaaaagttctgtctttctctctccctattcctcccccattgtttaattgagatatacatgttttaatgggcagtggatcagtattgtttctggggaaatccacaccttaaaaggccaggcttccccagcccaacttacctgtgacccacctacatgtgttcaccttttgggattctgaagaccctgctatctagacctagtctcctgtcataaagacattatttctatagtggtttatgtctctcttactctttgtcccaaatgacagagaccaatctagaaattggaaataaattattaacgtccaactttccaccaaaaaacatataaataggctcttagattttaaaaatattaaatctatagatattttaaccaattaaaacaatttctacatattccattccccacattttccatcgtcataacaatgatgcttctcatgatacgtacatctactccttgaaaaagtattctggtggtggtgtggctaatgattgacaaatatttctgtaaaatttctgcctgtttgcctctagaattctgcattatacaggcaaattttctttaaagctagagacttgtgctaaatttgcctgattttcatacagatatgctgtagtaatacagctaccttttcatttcatctttgtgctttggttaacaagcaggctcaagagactgctttgtgtaattaaatgaattgacctaaacatgagctgtcaggtgaatacttaatatttccatgcagatacagaattccatattgtgttcagtaaatttcttttggttcttcacagtgaagaaagaatgtttctaacctaacatttgtagaaggatactggaaaattccttccaggaaggaaggaaggaagatgccattacttggtgtatttatgatggatgaccacaaagctattgttctaccagttattaattaccttctaagatcttcagttactgctttattaatgtcactgaaattctaaaaaccaggacattcttcccccgttcattttatgcttcatggttgaaatttttctgtcagtgagtggaaaataaccatgagatacatagactgtagcgcaaatggaactgttgaaagttccttagaaagccagtgctgtggcattggagactacggagagagtcttctctaccagcactgcatgatctcagcctagaaatgagccaaagctgtcttccaaccagagtagcatatacatgtgtctgacttttcccctagcctgttgaacattcaatgaaaattcacagaatgaacaaattcaatgtttaaacagccattgaaatgctttcatagtgcttcatttgtaaatattttgtttgaaatgtattggaatagtatgaaaattagcgggaggtttggatccctgccttattttcatatgctgtggatacatctctgggagcttgcagcacccttctcaaaactcaactgtcatatggagctcatttgctactcaaaccatagacagattatttaacaaaagtgatataatgaccttcagtatttttctattgaacaagtttaacaacttttgccattaaacaaatacttagttatgcaaaatatttcgcttttataatcattttagttatgactaaaacgggggaaattgagctgcatcactgatgatgaactttgtgagaaattttttttttaatctgactttcattccttcagtattcttgctataaatttcttttggagataatgatgaagatttatttgaaaatgtctaaaatgtatgtatattttataaatatatattatatatattgtaagaatatatataatatataaactatatatatatatatatatatatatatatatatatatatataaaccataggtgcattttactgttttgtattttcatttttggaggtagtatacacagcagataatgatgagtatgatgagtgttgtgctgtttgcttttgcagtataatatatagttctaagtgtttaaattactgtatatacaatattcattataggctagcatgcttgttttaaagactgtcattctagtgtattaaaatctgaatgtaagaaaacctggctattcaaatgtgaattgaaaaatattttattctcagtactgaactatttccattgaacattcagactttttaacaaaaacaaatatcatcaagaaggcaatagctagaaaatgagaggtgcctttaaaaaaaaaaatgcagccttacagtgaggatgaagattgagtttggggagggggtgggagggggggcacagagagagagagagagttagtgtgtgtgtgtgtgtgtgtgtgtgtgtgtgtgtgtgcatgcatgcgtgtgtgtgtgtgtgtgtgtgtttaccaatctgtgaaggtcctgatttgtgaccatcaatgtctttttaatgtatctgctcaacttctaggacttcaggggacatttcatgcgctttgtgctcttctgagcaccatatatactttccaagaattttgaatgtgaattcctagaaatttcagtagagaaaacaatagctattctttaattatagtaaagttcaggtagaaggagaaattatttgttcaccaaaattatgggatctcattaatgttggctaagtaaatgtaattttttaaaggctcactttttaatacttcatatatttccctcttacaaaacagcatgtcatgaagttcttatgtggtaaagattcaactagtaaatatttttaggttaaatacctgaactagttaaaattccacctaagaatagtcttaaaatatttaaaaagcatctctcatatctacctctttgtcattgctgccattttaactgaagcaaatctttatgacatctgaaatgatggttggatgcaattaaaaaaaaatctatgttggtgcttttctcaggctttgtcatttaagttatattgtattaagatgtcacaaatcagactgaaaggcttagaattaattttgtttttctttgaaagaattgcttaaaattaaccatcaatgtttttagcgagtggagataatgaatctttggttggtgtctgtctgtgtgatgttttcaaccaatagccaaataattattgaacttacatgaaaaagagtgctaagtataattttatttagattactttattctttgaaagtgactacaaggctattaagtacataatcattcattttatttactcagaagttgcctctccattactgttaacttgtttagtaatttatataattgcagtacttttaagtgttggacactgggattcaggttgtatacaaagtagtagctgacgaaaaatatgtatatttttgtgaaatgtatcaagccctaaagttcattttagagaaaggcccagaaaaacgtatctgtgtttaaaaacaaaggacaggtcattcgtcaatttgaatcatttttacttttgccactacaaactttttaattggcaatatccatcatccaactggatcttcatgtcagtgtcagggatgccaggttgacaaagtatttaacagatcctttcagtttttgttttgtttttttaattctaaaaaaaacaaatgttaggccaaacagatccctagatcccactcattgattctggcggtattcctaaagtggtgcttagggggtcagaattttctggatctttgctaatccaagctttagatttaatttaaccaggaccacatgcttgtcatctctctgatgcaaattttcaaaatcattttaatttagattctaatgtctgcctgggtttttaacaggctgtgaaccagtgagtgccttgttaatgtagaatgatttttcccccctgggtgggtgttagttagctcctctctgaaaatgtctcagagaatggtattttaattgacttgtagagagctgctaaatttgttattatcagcaatcagaaagtctttggtctaccacacatctccctccctactatctcttcattgtttggctgaagtttgcctcttgtgagaaaacaatacaactccccttctccacacactttttttccagcccagattaataggtatcccctaccctaatcccaactctatgatctaataccttttttaggaggaaccacttctttttaatattgaaatctgctggttactttatgttttctcaagttcagttgactagagctgaccacagggtgtcatcaattcagattcctaaataaccctttctctccacacccagtcctccagctggtgagccctgggccagattgtttgatcttcaggtattttaaattttagttacatcaattaatgtaaattaatccaaatgctaatttttgtggtgcaagaagtttcttatgtaaattcagggtatggataagctaattaagatatccatctttggtggctctaagtgtattatttgtttttaaataaagtgtacaaatatagataacatgctataggtgtctcatgaattggaatatttgtcagatttgggatctagctgtggctttacagtaatcagttaaattaacatagtctgatttggggcttttgggggaggagttgtagaggggtgcagagaaataaaaggatattagacaaagta

SEQ ID NO: 6669 - DNA, 3323 bp, Homo sapiens
atggacgagcaggcgggtcccggcgtcttcttcagcaacaaccacccgggcgccggcggtgccaaggggctcgggcctctggcgggggcggcccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtacccta

SEQ ID NO: 6670 - DNA, 3395 bp, Homo sapiens
cggccgccatggacgagcaggcgggtcccggcgtcttcttcagcaacaaccacccgagcccagtacagtctcccggggatcctgcacttcctgcagcacgagtgggcccgcttcgaggtggagagagcccagtgggaggtggagcgggcggagctgcaggcccagattgccttcctgcagggagaaaggaagggccaagaaaatttgaagaaggatcttgtgaggaggatcaaaatgttggagtatgctcttaaacaggaaagagccaaataccacaagttgaaatacgggacagaattgaatcagggagatatgaagcctccaagctatgattctgatgaaggtaatgaaacagaagtgcagccacaacaaaacagccagttaatgtggaaacaaggtcgacaactactcagacagtatctacaggaggtgggttatacagatactattctagatgtgaaatctaaacgagtgcgagctttgttgggcttttcaagtgatgtcacggacagggaagatgacaaaaatcaggactcagttgtaaatggcacagaggctgaagttaaagagacagcaatgattgcaaaatctgagttaacagattctgcctccgtgctggataatttcaaattccttgaaagtgcagctgcagatttcagtgatgaagatgaagatgatgatgttgatggaagagagaaaagcgtcattgatacttcaacaattgttaggaaaaaagcattgcctgacagcggtgaagatcgagatacaaaagaagctctaaaggagtttgacttcttggttacatcagaggaaggagacaatgaatctagaagtgcaggcgatggaacagactgggaaaaggaagaccagtgtctcatgcctgaagcctggaatgtggaccagggagtaattaccaaactcaaggaacaatacaaaaaggagagaaaggggaaaaagggggtgaagaggcccaataggtcaaaactacaagatatgcttgctaatttgagagatgttgatgaacttccttcattgcagccatctgtgggttcaccttccagacccagcagctccaggcttcctgaacatgaaattaatagggcagatgaagtggaagcattgacatttcctccttcttctggaaagtcattcatcatgggagcagatgaagcccttgaaagtgaactgggacttggagaactagcaggccttacggtggccaatgaagcagactcactaacttatgatatagcaaacaataaagatgcattgaggaagacatggaaccctaagtttacattgagaagtcactttgatggcatccgagcccttgctttccatcccattgagcctgttttgataacagcatcagaggatcacacattaaaaatgtggaatttacagaaaacagccccagccaaaaagagcacttctcttgatgtagaacctatctatacattcagagcccataaaggtccagtgctttgtgtggtaatgagcagcaatggtgagcagtgttacagtggtggtactgatggactgatccagggctggaataccactaatcccaacatcgacccctatgattcttatgatccttctgttttacgaggccctctgctaggccacacggatgcagtctggggtttggcttatagtgcagcacatcagcgtttgttgtcctgttcagcagatggcactctgcgtttatggaatacaactgaggttgctccagcactaagtgtatttaatgatactaaagaactgggaatccctgcctctgtggatctagtgagcagtgacccgagccatatggtagcatcattcagcaagggatatacaagcatttttaacatggaaacacaacaacgcattctcactttagaatccaatgtagatacaacagccaactcttcctgccaaataaatagagtcatcagtcatcctactcttccgatcagcatcactgctcatgaagacaggcacatcaaattctatgataacaatacaggcaaactgatccactcgatggtagcccacctagaagctgttacaagtttagcagttgatcccaatggcctttacttgatgtctggcagtcatgactgttcaatacgtttatggaatctagaaagtaagacgtgtatccaagaattcacagctcatcgaaaaaagtttgaagaatcgattcatgatgtagctttccacccatccaaatgctatatagccagtgctggagctgacgcactggctaaagtctttgtatgacgcaatgcatcatcttcaccttctagctgtttataagtaatcaactgcacacaagagatacagaagacgagggcaagaatcatctcgtcctgcccttttgttctgctgaaggagcacagagaacatttgttgaagtatagttttgcaattcatatactgttttctaaaactaaggtttgttcaggttgctgcaagctcagctgaatctgtgagcctgaggtctgtttcaaatttctccccaataggcgcctttatttctgaggtggttctaattcgctaggcaggcctgagcgaatacaagtttagcttgtccctgttgagtaagtagggcatgctacaatggataatttaaaagcttgatagctgggactgaatagaagaaaacgggaaacttagaccaagttctcccctgagaaatcttgttaaaacacattaagtagtcaaaatagtaatctttatcatatctgccatattaacccctttgtgtataatgaccaggcagtgttaaactgagtttttaatttgactctcctttcagctgttcacataaagcacctggcaaagcattttacctgttagggggagaaaaatgcaataatatgttaaatatattattattcagaaatgctagacaaatagtttgcaagcagatttctatattgtattacagttttgaaaacagatttggtatcattctaaagtttagctatcaagcactcaccattgtgaagaatagttgatcgactctgcttttactaacagatttaacttattcaggtttgaaattctgtttatttttaagggtaaacagggcatatctctttaataatttctattttaaaattcactttattcatgtgacatttatagtaccagagtgattatttcataccaatgaaatcttacttttcagtgactgaaaagatagaatttatttgctaataatcatttatcaacacccacctaatcatgcttcagatgatctgtgctctttcttctttgtcacgttcaagttatctgacatctaccaagaacagttcataattattaatagcccaaagagtatggttaacttcacgcagctgcttttgcagaagcactaataaaaacaaatattttgtacccta

SEQ ID NO: 6671 - DNA, 3970 bp, Homo sapiens
aaagtgagtgagtgagacgggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagtacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaaggactccagtatttgtggcctgtactggatgtgaactgagcgtatatctgtttttaggtgtctttaagccaatgtggagtctgatctttcaaaaaagtttttttttttctcttcttcttcttcttttttttttttttttttttttttttggactctgtgtgctgccttaggggttaggaatgtggtgctcttgttgggggaagtgagctccaagagtagctttttttcatctcttagtgatcttctgtttatcggttgaatgccacagattcccttttaaacttattttgctttaaaaaaaaaaaaaaagaaaaagaaaatttaacttaaaatattttagcattagttgcacaaaatgtttggataaaattctagtttttataagtctttttatatatttagcctgtcacaacagtgctcaagattgtattgaagtttttctgcattatacaaccctaaaacacagagatctcactgacccgttgccctgtaaccactttctttccttcttttgcctaatacagctcagctaagtccttccataaagatgctaaataactttcatcatcacataaatgtcttcataaaccaaggactattaagtgtattaaaatgaaacagtggggtttagtactccaaatgaactcttaaagaaaaaaactaatcttggcatcctatcactatgtgatattttgtacatcttactgtatttacaagtttatttatcaaggattatccatcttgctaatggcctattatttatttcactttttgttggtctttatatccttttattaatgtgctaaaggaacctgtatatctattttggaactctttgaatagtctaaaatagactaaaaatggagtattttatagtttaaattacaaaccaaggtggttccccctaagatatatatcttggtttaccatgattccaaacaaaactaacttgtttaaaaatatttggagtaaagttttatttgcattacaaataggatacaaaaatagttgaatcaggatacagaaatctgctgtgttttgactagttatccctgttttatttttttagatgtgcttaattttatggtgtaactaaagattttgtttgtgtaatgcatgattaagacaataaagtattttttctagtcttccgagaaacttttctgatcagtttgcgagttttgatgagttttgtaaggtttttgttttacaaactatgaatcagcaaatttttaagattgtaccacatagcaaacatacagctgttgaaaaataatgtatataaaatgcatataataaatattaaattgtgtacctgtatgttactgttggctacatcattttgtgttgaataataaagtgcaatactttattctccataattaaactaggaaatggagattt

SEQ ID NO: 6672 - DNA, 2799 bp, Homo sapiens
ggcagatggaggagggattgtaatggcggcagccggcagctccctgctctgacccacggcaggcacacagcaacgaccccttccccgcccctctcccggccggcctccgccccgcagccagcgcggggccaccctctccggcccttcccccagctgtcggcgtctcgccctgcgccccggccggggccccacacacaatggacgagcttgccggaggcggtggtggcggcccggggatggcggcccctccccggcagcagcagggacctggggggaacctgggcctttcgcccggggggaacggagcggcgggcggcgggggtcctccggcctccgagggagcgggtcccgcggcaggccccgagctgtcccggccgcagcagtacactatcccggggatactgcactacatccagcacgagtgggctcggttcgagatggagcgggcgcactgggaggtggaacgggccgaactgcaggcccggattgcatttctacaaggcgaaagaaaaggtcaagagaacctgaagaaggacttagtaagaagaataaagatgttagagtatgcattaaaacaagaaagggcaaaatatcacaaattaaaatatggcacggaactgaaccaaggtgacttgaaaatgccaacctttgagtcagaagaaaccaaagacacagaggctcccacagcacctcagaatagccagttaacgtggaagcaaggcagacagcttttaagacagtatcttcaggaagtaggttatacagatacaatattagatgtacggtctcagcgggtaaggtcattacttggactatctaattcagaaccaaatggatcagtagaaacaaagaatttagaacagatcctgaatggaggtgaatctcctaagcaaaagggacaagaaataaaaaggtcctctggtgatgttcttgagacgttcaatttcttagaaaatgccgatgacagtgatgaagatgaggaaaatgacatgatcgaaggcatcccagaaggaaaagacaaacatcggatgaataaacataaaataggtaatgaaggtttagctgctgacctaactgacgatcctgatactgaggaagcactgaaagaatttgattttttagtgactgctgaagatggtgaaggagctggagaagcacggagttcgggggatggcacagaatgggataaagatgacctctccccaactgctgaggtttgggatgtagaccagggactaataagtaaactgaaggaacagtacaagaaggaacgaaaggggaagaaaggggtgaagagggccaacaggacaaaactctacgacatgatagctgatctgggagatgatgagctgccccacatcccttcaggaatcattaatcagtctaggtcagcctctactagaatgactgatcatgaaggtgcaagagcagaggaagctgaaccaataacgtttccatctggaggaggcaagtcatttattatgggttctgatgatgttttgttaagtgtactgggccttggagaccttgcagacttgacggtaacaaatgatgcagactatagttatgatttgcctgctaataaagatgcctttcgaaagacatggaatcccaagtatacactacgtagccattttgatggagtacgggcattagcttttcatcctgtagaacctgtgctggttactgcttctgaggaccataccctgaaactttggaacctgcaaaaaacagttcctgccaaaaagagtgcctctttagatgtagagcctatctacacatttagggcccacatcggccctgttctgtcattagctattagttctaatggagaacagtgttttagtggtggtattgatgcaaccatccagtggtggaatatgccgagtcccagtgtagatccatatgatacatatgagccaaatgttctagctggcactttagttggtcatacagatgcagtttggggtcttgcttatagtggcataaaaaatcaattactgtcttgttcagcagatggcactgttaggttatggaatccacaagaaaaattgccatgtatttgcacttacaatggagataaaaagcatggaatacctacatcagttgactttataggctgtgatccagctcatatggtaacctctttcaacactggtagtgcagtaatttatgatttagaaacatcacagtcattggtgatactttcatcacaggtagattctggtttacaatctaataatcatatcaacagagtagtaagtcatcccacacttcctgttacaataactgctcatgaagatagacacatcaaattttttgacaataaaacgggtaaaatgatccattctatggtagctcacttggatgctgttacaagtctagcagtagatcctaatggaatctatttgatgtctggaagccatgactgttccatcagattatggaatttagacagcaagacatgtgtgcaagaaataacagctcacagaaagaaattggatgaatcaatttatgatgttgctttccactcgtcaaaagcatatatagctagtgcaggagctgatgctcttgccaaagtatttgtatgaatcaacaaaaacttgcatcgtaacaagatttgcttggacagaaagagggtctgcatcactgccatcagaaaggttactgatatgacactacatgtgatctgcctggtgaaggctatctggggcaggcacaaattggtggaaatcacatcttaatgtcaagctcattaagttaactgtaattactgtattttgtgggacaaagaaaaaa

SEQ ID NO: 6673 - DNA, 2828 bp, Homo sapiens
attggcctggagccagccaacgggggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcct

SEQ ID NO: 6674 - DNA, 2402 bp, Homo sapiens
ggacccggctcctgccagggttgggtgcgccgctgaacggatggctgagggagccccgcggatcgtttaggaaagccggccaggcattccagaaaacagctgcaaaccctgagagatatggctggattgttgacctcctggagtagttaggcctttatttttagttgcaaactgatcgtcgtgtgttgccacccattcatgtcaagatgactaagtttggatttttgcgattgtcctatgagaagcaggacacacttttgaagcttctcattctgtcaatggctgctgtattatccttctccactcgtctgtttgctgtcctgagatttgaaagtgttatccatgagtttgatccgtactttaattatcggactaccaggttcctggctgaggaggggttttataaattccataactggtttgatgaccgagcctggtaccctttgggacgaatcattggaggaacaatttacccaggtttaatgatcacctctgctgcaatctaccatgtactccattttttccacatcaccatcgacattcggaatgtctgtgtgttcctggcccctctcttctcctccttcaccaccatcgtcacgtaccaccttaccaaagagctcaaggatgcaggggctgggcttcttgctgctgccatgattgctgtagttcctggatatatctcccgatctgtggctggctcctatgataatgaagggattgccatcttttgcatgctactcacctactacatgtggatcaaggcagtaaagactggttccatctgttgggcagctaagtgtgcccttgcttatttctacatggtctcgtcatggggaggttatgtgttcctgatcaacttaattcctctccacgtcctcgtgctgatgctcacaggccgtttctctcaccggatctatgtggcctactgtactgtttactgcctgggcactatactttctatgcagatctcctttgtgggtttccagcctgtcctttcatcagagcacatggcagcctttggggtctttggtctctgccagatccatgcctttgtggattacctgcgcagcaagttgaatccacaacaatttgaagttcttttccggagcgtcatctctctggtaggctttgtccttctcaccgtgggagctctcctcatgctgacaggaaaaatatctccctggacggggcgtttctactcgctgctggatccctcttatgctaagaacaacatccccatcattgcttctgtgtctgagcatcagcccacaacctggtcctcatactattttgacctgcagctcctcgtcttcatgtttccagttggcctctattactgctttagcaacctgtctgatgcccggatttttatcatcatgtatggtgtgaccagcatgtacttttcagctgtaatggtgcgtctaatgctagtgttggcacctgttatgtgcattctctctggcattggagtctcccaggtgctgtccacatacatgaagaatctggacataagtcgtccagacaagaagagcaagaagcaacaggattccacctaccctattaagaatgaagtggcaagtgggatgatactggtcatggctttctttctcatcacctacacctttcattcaacctgggtgaccagtgaggcctactcttctccgtccattgtactatctgcccgtggtggggatggcagtaggatcatatttgatgacttccgagaagcatattattggcttcgtcataatactccagaggatgcgaaggtcatgtcctggtgggattatggctatcagattacagctatggcaaaccgaacaattttagtggacaataacacatggaataatacccatatttctcgagtagggcaggcaatggcgtccacagaggaaaaagcctatgagatcatgagggagctcgatgtcagctatgtgctggtcatttttggaggcctcactgggtattcctctgatgatatcaacaagtttctttggatggtccggattggagggagcacagatacaggcaaacatatcaaggagaatgactattatactccaactggggagttccgtgtggaccgtgaaggttctccagtgctgctcaactgcctcatgtacaagatgtgttactatcgctttggacaggtttacacagaagccaagcgtcctccaggctttgaccgtgtccgaaatgctgagattgggaataaagactttgagcttgatgtcctggaggaagcatataccacagaacattggctggtcaggatatacaaggtaaaggacctggataatcgaggcttgtcaaggacataaatgtcacgtccagctctgatatgcttcgcactgagcacatcacatttaggacgttgaagatttttttttttttttttt

SEQ ID NO: 6675 - DNA, 4246 bp, Homo sapiens
gcggccgctgctgaggcggagactccccgccgccgcttcctccacccccagtccgccggcctcgcggcgctgagggcgggagcgcgcagagctcttccctcctcctttttcttcctcctcctcctcctcctccgggtccccgcccagcacccctcgcaccaggcggcggcggcggaggaggagagctagacccgccgccggggcacaacatggcggagccctcggccccggagagcaagcacaagtcgtccctcaactcgtccccgtggagtggcctcatggccctgggaaacagccggcacggccaccacgggcccggggcccagtgcgcgcacaaggcggcgggcggcgcggcgccgccgaagccggccccggcggggctgtccggggggctgtcgcagccggctgggtggcagtcgcttctctccttcaccatcctcttcctggcctggcttgccggcttcagctcgcgcctcttcgccgtcatccgcttcgaaagcatcatccacgagttcgacccgtggtttaactatagatcaacacatcatcttgcatctcatgggttctatgaatttttaaattggtttgatgaaagagcatggtatccactaggaagaatagtaggtggtactgtttacccagggttgatgataaccgctggccttattcattggattttaaatacattgaacataactgttcacataagagacgtatgtgtgttccttgcaccaacttttagcggccttacatctatatctactttcctgcttacaagagaactttggaaccaaggagcaggacttttagctgcttgttttattgctattgtaccaggctacatatctcggtcagtagctggatcctttgataatgaaggcattgctatttttgcacttcagttcacatactatttatgggtaaaatctgtaaaaactgggtcagttttttggacaatgtgctgctgcttatcctatttctatatggtctctgcttggggtggttatgtatttatcatcaatcttattccactgcatgtatttgtgttgttactgatgcagagatacagcaaaagagtctacatagcatatagcactttctacattgtgggtttaatattatcaatgcagataccttttgtgggattccagccaatcagaacaagtgaacacatggcagctgcaggtgtctttgcattgctgcaagcttatgctttcttgcagtatctgagagaccgattaacaaaacaagagttccagacccttttctttttgggtgtatcactagctgcaggtgctgtgttccttagtgtcatctatttgacttatacaggttacattgcaccatggagtggcaggttttattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacagttgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgtgtt

SEQ ID NO: 6676 - DNA, 1439 bp, Homo sapiens
gtcagaagctatatccagctgctggcagagttcctgtcaagggatcaagtcttccaacagaatggttatggtttaactcagcagaatttgttgaacaactacgacatgctggggatcatggcatggaatgcaacttgcaaaaactggctggcagcagaggctgccctggaaaagtactacctttccattttttatgggattgagttcgttgtgggagtccttggaaataccattgttgtttacggctacatcttctctctgaagaactggaacagcagtaatatttatctctttaacctctctgtctctgacttagcttttctgtgcaccctccccatgctgataaggagttatgccaatggaaactggatatatggagacgtgctctgcataagcaaccgatatgtgcttcatgccaacctctataccagcattctctttctcacttttatcagcatagatcgatacttgataattaagtatcctttccgagaacaccttctgcaaaagaaagagtttgctattttaatctccttggccatttgggttttagtaaccttagagttactacccatacttccccttataaatcctgttataactgacaatggcaccacctgtaatgattttgcaagttctggagaccccaactacaacctcatttacagcatgtgtctaacactgttggggttccttattcctctttttgtgatgtgtttcttttattacaagattgctctcttcctaaagcagaggaataggcaggttgctactgctctgccccttgaaaagcctctcaacttggtcatcatggcagtggtaatcttctctgtgctttttacaccctatcacgtcatgcggaatgtgaggatcgcttcacgcctggggagttggaagcagtatcagtgcactcaggtcgtcatcaactccttttacattgtgacacggcctttggcctttctgaacagtgtcatcaaccctgtcttctattttcttttgggagatcacttcagggacatgctgatgaatcaactgagacacaacttcaaatcccttacatcctttagcagatgggctcatgaactcctactttcattcagagaaaagtgaggggcttgtgaaacagattgttctacagatgaatctgtaagccagttacagtttgccttaactcatagacatcaatcagagagtgtcacagatttaaccttgatctaaagacaagttgtacccagagtatgtgaaaagaatgggacgacaagaatgtactggtttcttcctctaagaattgaaaggagttgaactgccttatgtttgggcatgtaactccaaaatactaggtagtataaggctttctcaatcagtgcaaaaatggaagatatataaagcaacaagttgtctgcatttgatcactggtcagattgtaaaaaaaaaaaaaa

SEQ ID NO: 6677 - DNA, 1516 bp, Homo sapiens
cccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggtacttttatggaaaaaaaaggaagttatatgcacataaaacaagaaacaggaaattcaaatgagaatataactggtatccaagagaacgtcgcccaccaaaatctgagtaagtgtgccatcagcatttttttatgttaaagatttactttgctaagatacttgctgagattacttttccaaattaatgaatatcatcacaaaattatttttttacatttgggttcagctgcatgctaatggaaatggaaaatggaagggcatggcttatagctgttcattcaccaaaaatattttagaattgtgtcca

SEQ ID NO: 6678 - DNA, 2352 bp, Homo sapiens
ctgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggctgcagatcaaattacgaagctgtataatctcttcctgaaaattgatgctactcaggtggaagtgaatccctttggtgaaactccagaaggacaagttgtctgttttgatgccaagataaactttgatgacaacgcagaattccgacaaaaagacatatttgctatggacgacaaatcagagaatgagcccattgaaaatgaagctgccaaatatgatctaaaatacataggactagatgggaacattgcctgctttgtgaatggtgctgggctcgccatggctacttgtgatatcattttccttaatggtgggaagccagccaacttcttggatcttggaggtggtgtaaaggaagctcaagtatatcaagcattcaaattgctcacagctgatcctaaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcataagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgtaa

SEQ ID NO: 6679 - DNA, 1948 bp, Homo sapiens
ctgccccgtgccgagtttcctgtttaagatggcgtcccccgtagcagcgcaggccgggaagcttctgcgagccctagcgctgcggccccgcttcctggcggccgggtcccaggcagttcaattaacctccagaagatggctgaacctgcaggaataccagagcaagaaactgatgtctgacaacggagtgagagttcaaagattctttgtagcagacactgcaaatgaagctctcgaggctgctaagagactaaatgcaaaagaaattgttttaaaagcccagatcttagctggaggaagaggaaaaggtgtcttcaatagtggtttgaaaggaggtgttcatttaacaaaagaccctaatgttgtgggacagctggctaaacagatgattgggtacaatctagcgacaaaacaaactccaaaagaaggtgtgaaagttaacaaggtgatggttgctgaagccttggatatttccagagaaacctacctggcaattctgatggaccggtcctgcaatggccccgtgctggtgggcagcccccaggggggcgtcgacattgaagaggtggctgcttcaaacccggagctcatttttaaggagcaaattgacatttttgaaggaataaaggacagccaagctcagcggatggccgaaaatctaggcttcgttgggcctttgaaaagccaggttgaagccatccttgtcaatatatttggtggtatcgtcaactgtgccatcattgccaatgggatcaccaaagcctgccgggagctagaactcaaggtgcccctggtggtccggcttgaaggaaccaacgtccaagaggcccagaagatactcaacaacagcggactccccattacttcagccattgacctggaggatgcagccaagaaggctgtggccagtgtggccaagaagtgatgtctttgtcctgatccaatggagaaagaaagccatttttccgtaaaaagggatggttcatcattgtgaaagaaatggttatctcattggggaagaaaaggggagggggaaggcaagaatcactgaaaaatcttaaatctgtgttttctggaataagatatctagacagcctaaatctgattttggtctttataaaaataatatcttgtgttctcatacttttctgtcactgtaagcctgcccagtaggcagtgttttgcagactttggggagtggtctatgtggccaaatattgtgtgtatagacagaatttgaaatcaagtcctgcttcatttacaagaattttggtgggcatctaatcctacataatgaaaaagaaaaacagaccatttaaaaactcagacaagattatatttaatatattaattactaaaaaggcataagattacactgaacatattagctactaaaaaggcactgctaagacattcaagcaaatagctattacacactactgcagattttacaggtttctaattctaacatatgtttgaaaaatccgtgagtattccaaaatatatttaataatggaatatctgcattaatataccatccatgtgtttttaccatttgccttaatattgaatatactgtttacctcacactaaaaagaaaaccagaagccttatttgtgattttgggagtggaagcttccatttttgtgtcaaaaatgaatcctgattcttatggaaatctctgttattaagatatttcaagatgagacaacactgaagatcaaattgtgtttagtatcactatcttctctcctcgtttctctcttactcctcatcctcccagaatctaccagtttatggtagaaagatgggaaccttatttgaatgtgttttttttttccatgatgtccaattttgttgtgggaaaggatttggataaaatttttgtttaaattttggtagatttttatctatacaaatttaaataaaattatgttttgtaagctgt

SEQ ID NO: 6680 - DNA, 1894 bp, Homo sapiens
tgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctc

SEQ ID NO: 6681 - DNA, 1876 bp, Homo sapiens
atgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctca

SEQ ID NO: 6682 - DNA, 1287 bp, Homo sapiens
catgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactag

SEQ ID NO: 6683 - DNA, 1683 bp, Homo sapiens
gcaatggtatgacgcacaaaagcaatcttaaggggaatgaaaactgtccaaaggttcagaaaagtagtgaaggggcctctggaacggccgggaccctcaacgtggttttccttaattccctgggcggtcctgaaggtggtgtggccagtcctccgcctcgctccgtcagtttccccctgctgaactattgggtgcggggcgggtggtggcgcagcctgcgcatgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagac

SEQ ID NO: 6684 - DNA, 881 bp, Homo sapiens
atgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcaggtacatcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcac

SEQ ID NO: 6685 - DNA, 2052 bp, Homo sapiens
tgtgcataggggtcgactgccgctgcggtgcatgagggcgcatgcgcagcggggccgtgggtgtacgcggcgcagcgcggcagtcctgatggcccggcatgggttaccgctgctgcccctgctgtcgctcctggtcggcgcgtggctcaagctaggaaatggacaggctactagcatggtccaactgcagggtgggagattcctgatgggaacaaattctccagacagcagagatggtgacgggcctgtgcgggaggcgacagtgaaaccctttgccatcgacatatttcctgtcaccaacaaagatttcagggattttgtcagggagaaaaagtatcggacagaagctgagatgtttggatggagctttgtctttgaggactttgtctctgatgagctgagaaacaaagccacccagccaatgaagtctgtactctggtggcttccagtggaaaaggcattttggaggcagcctgcaggtcctggctctggcatccgagagagactggagcacccagtgttacacgtgagctggaatgacgcccgtgcctactgtgcttggcggggaaaacgactgcccacggaggaagagtgggagtttgccgcccgagggggcttgaagggtcaagtttacccatgggggaactggttccagccaaaccgcaccaacctgtggcagggaaagttccccaagggagacaaagctgaggatggcttccatggagtctccccagtgaatgctttccccgcccagaacaactacgggctctatgacctcctggggaacgtgtgggagtggacagcatcaccgtaccaggctgctgagcaggacatgcgcgtcctccggggggcatcctggatcgacacagctgatggctctgccaatcaccgggcccgggtcaccaccaggatgggcaacactccagattcagcctcagacaacctcggtttccgctgtgctgcagacgcaggccggccgccaggggagctgtaagcagccgggtggtgacaaggagaaaagccttctagggtcactgtcattccctggccatgttgcaaacagcgcaattccaagctcgagagcttcagcctcaggaaagaacttccccttccctgtctcccatccctctgtggcaggcgcctctcaccagggcaggagaggactcagcctcctgtgttttggagaaggggcccaatgtgtgttgacgatggctgggggccaggtgtttctgttagaggccaagtattattgacacaggattgcaaacacacaaacaattggaacagagcactctgaaaggccattttttaagcattttaaaatctattctctccccctttctccctggatgattcaggaagctgacattgtttcctcaaggcagaattttcctggttctgttttctcagccagttgctgtggaaggagaatgctttctttgtggcctcatctgtggtttcgtgtccctctgaaggaaactagtttccactgtgtaacaggcagacatgtaactatttaaagcacagttcagtcctaaaagggtctgggagaaccagatgatgtactaggtgaagcattgcattgtgggaatcacaaagcaaatagtactccagaaagacaaatatcagaagcttcctattctttttttttttttttttttttttgagacagggtctttctctgttgcccaggctagagtgcactggtgatcacggctcactctagccttgaattcctgggcccaagcaattctcccacctcagcctcctgagtagctgggactacaagtgtgcaccaccatgcctggctaattttttgaatttttgtagtgatgggatctcgctctgttgcccagggtggtctcgaactcctggcctcaagcgatcctcccacctcgacctcccaaagtgctgggattacaggtgtgagccacctcgcctgggcccccttctccatatgcctccaaaaacatgtccctggagagtagcctgctcccacactgtcactggatgtcatggggccaataaaatctcctgcaattgtgtatctca

SEQ ID NO: 6686 - DNA, 2586 bp, Homo sapiens
agcttcccgagcgagccctgcggccgccggagcagctcccgcggcggagcaggagccggatggtcagaggagcccggcagccccagcagccgcggagtcgcctggcccccagactgactggcacagtggagaaaccgcctcgaaaacggagaagcaggactgaatttgctcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcgaaacaagttttcattttccacaaattttaaatggtgcagttttctaacgtgataagacacatagtggtgttacttagtttttattttttaatttagggccaccattttaaaaacaaacaaaaaaatgttcacacttttagggtaactgttttaaaatgcaacctttcaggtcttttaaaatcttaaccttggaatttttattttttgattttgagggatggatatttacctccaacttctaatcctacactcaaatagtcactattctcaccctgagaagagtaaatcatttatttttgtataatgaggtaaatccaactcttatacttggacctaagttaaatgtctggatttggaaatatgtaatggttcataatgatgaagctagccaccatggactactgaaaatcaagaacagagtccctccataatatattttttctcattccaacttagctggtagaaaaatgtttgatcctttgaaacatgatcaagccagttttttgaaatcatttaatttctttcaatactgtcataatttcagaaattggattgaattgcatctgaaagctacatcttgattgaggacttgaggtggtaatattacttggaatgtatgagtattatgagatttatttgcatattttctttgtagtctgtgaatgctggaaatgaaaaaggaaacaa

SEQ ID NO: 6687 - DNA, 1968 bp, Homo sapiens
agcttcccgagcgagccctgcggccgccggagcagctcccgcggcggagcaggagccggatggtcagaggagcccggcagccccagcagccgcggagtcgcctggcccccagactgactggcacagtggagaaaccgcctcgaaaacggagaagcagtatcagaggttctggtgatagcagtcattcacaatctcaaggggaaagatatcaacatttcactgaaaagactgaatttgctcttaaagaaatcatgtcctctggaggtgctgaagatgatatcccacagggagagaggaaaacagttacagatttttgttatcttctggataaatctaagcaactgttcaatgggttaagagatttgccacaatatggacagaagcagtggcagtcctattttggaagaacttttgatgtttacaccaaactctggaagttccagcagcagcatcgacaagtcttggataatcggtatggcttgaagcgctggcaaataggagaaattgcttccaagattgggcagctatactatcattattacttacgcacatcggaaaccagctatctgaatgaggctttttccttctattctgcaatcagacagagatcatattattctcaagtcaataaagaggacagacctgaattggtagttaagaagttacgatattatgcaagatttatagtagtttgtcttcttctcaacaaaatggatgttgtaaaggatctggtaaaggaattgtcagatgaaattgaagattatactcaccgatttaatactgaagatcaagtggaatggaacttggtgcttcaagaagtagcagctttcattgaggcggatcctgtaatggtattaaatgatgataataccattgttatcacatcgaatcgccttgctgaaacaggagccccattgctggaacagggcatgattgtgggacagttgtctctggctgacgcactcattattggtaattgtaataatcaggttaagttcagtgaactaactgttgacatgttccggatgttacaagctctggaaagggagccaatgaatttagcttcccagatgaataaaccaggaatgcaggaatcagctgacaagcctactagacgagaaaacccccacaagtatctgctctacaaaccaaccttcagccagctatataccttcttagcagcgtcttttaaggagctgcctgccaatagcgtgcttctgatttacctgtcggccactggcgttttccccacaggtcgttctgatagtgaaggtccttatgattttggaggtgtacttactaatagtaaccgggatattattaatggagatgccatccacaaacgaaatcagtcccacaaggaaatgcactgccttcatcccggggatctctatcctttcaccaggaagccactgttcatcattgtggattcgtctaatagtgttgcgtataagaatttcacaaacttgtttggacagccactagtctgcttgctttctcctacagcatatccaaaagctttacaagatcaatctcagcgaggtagcctcttcactctctttttgaacaatcctctaatggccttcctatttgtctctggattgtcaagcatgcgcagaggcctatgggaaaagtgtcaagaatatcttcgaaaaatcaaccgtgatattgcccagctactgactcattcacgttcaatagatcaggcatttctccagttttttggagatgaatttcttcgcttgctcctcacaagatttatcttttgttcagccaccatgaggatgcacaagatttttcgggaaacacgaaattatccagaatcatatccacaactgccaagggatgaaacagtggagaatcctcatctccagaagcacattttggaattagcatccattctggatgttcgaaacgtgttctttgagaataccattgatgactattaaaacaaaaaccctgttgtcg

SEQ ID NO: 6688 - DNA, 2149 bp, Homo sapiens
ctccttggctatggagaggcggcccccgagccaggccctccgccaccgcccccgggccatggccccccgccgccacccttcctcgcgcggcccggcccgcggggctcccggccgccgcagctgatggtgttccgcaacgtgggtcggccgccggaggaggaggacgtggaggcggccccggagccgggaccctcggaactgctgtgtccccggcaccgctgtgccctggaccccaaggccctgccgccgggcttggcgctcgagcggacctggggcccggcggctggactagaggcgcagttggcggctctggggctcgggcagccggcggggccgggggtcaagacagtcggtgggggttgctgcccgtgtccgtgtcctcctcagccgccccctccgcagccccagccgcctgctgccgccccgcaggccggggaggaccccacggaaacgagcgacgcgctgctggtcctggagggcttggaatcggaggccgagagcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagcagcagcagcagcagcaacctcccccgcccccgcctcctcccgggcccctccggccactcgcgggtccttctcggaagggctccttcaaaatccgcctcagtcgcctctttcgcaccaagagctgcaacggtggctccggcggtggggatgggaccggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacaggtgaaactgtgtcgcttgtggatgtggacatttctcagcggggcctgacctctccacaccctccaactccccctcctcctccgagaagaagcctcagcctcctagatgatatcagtgggacgctgcctacatctgtccttgtggctccgatggggtcttccttgcagtctttccccctacctccgcctcctccaccccatgccccagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggcatttggttgccaagctccagctttgaagaaccaaattaagctaccatgaaaagaagaggaaaagtgagggaacaggaaggttgggattctctgtgcagagactttggttccccacgcagccctggggcttggaagaagcacatgaccgtactctgcgtggggctccacctcacacccacccctgggcatcttaggactggaggggctccttggaaaactggaagaagtctcaacactgtttctttttc

SEQ ID NO: 6689 - DNA, 2030 bp, Homo sapiens
atggtgttccgcaacgtgggtcggccgccggaggaggaggacgtggaggcggccccggagccgggaccctcggaactgctgtgtccccggcaccgctgtgccctggaccccaaggccctgccgccgggcttggcgctcgagcggacctggggcccggcggctggactagaggcgcagttggcggctctggggctcgggcagccggcggggccgggggtcaagacagtcggtgggggttgctgcccgtgtccgtgtcctcctcagccgccccctccgcagccccagccgcctgctgccgccccgcaggccggggaggaccccacggaaacgagcgacgcgctgctggtcctggagggcttggaatcggaggccgagagcctggagactaacagctgctcggaagaggagctcagcagcccgggtcgcggaggaggagggggcggccggcttctgctgcagcccccaggccctgaattacctccggtgcccttcccgctgcaggacttggtccctctggggcgcctgagtagaggggagcagcagcagcagcagcagcagcaacctcccccgcccccgcctcctcccgggcccctccggccactcgcgggtccttctcggaagggctccttcaaaatccgcctcagtcgcctctttcgcaccaagagctgcaacggtggctccggcggtggggatgggaccggcaagaggccttctggagagctggctgcttcagctgcgagcctgacagacatgggaggctctgcgggccgggagctggacgcggggaggaaacccaagttgacaagaactcaaagtgccttttctccggtctccttcagccccctgttcacaggtgaaactgtgtcgcttgtggatgtggacatttctcagcggggcctgacctctccacaccctccaactccccctcctcctccgagaagaagcctcagcctcctagatgatatcagtgggacgctgcctacatctgtccttgtggctccgatggggtcttccttgcagtctttccccctacctccgcctcctccaccccatgccccagatgcatttccccggattgctcccatccgagcagctgaatccctgcacagccaacccccacagcacctccagtgtcccctctaccggcctgactcgagcagctttgcagccagccttcgagagttggagaagtgtggttggtattgggggccaatgaattgggaagatgcagagatgaagctgaaagggaaaccagatggttctttcctggtacgagacagttctgatcctcgttacatcctgagcctcagtttccgatcacagggtatcacccaccacactagaatggagcactacagaggaaccttcagcctgtggtgtcatcccaagtttgaggaccgctgtcaatctgttgtagagtttattaagagagccattatgcactccaagaatggaaagtttctctatttcttaagatccagggttccaggactgccaccaactcctgtccagctgctctatccagtgtcccgattcagcaatgtcaaatccctccagcacctttgcagattccggatacgacagctcgtcaggatagatcacatcccagatctcccactgcctaaacctctgatctcttatatccgaaagttctactactatgatcctcaggaagaggtatacctgtctctaaaggaagcgcagctcatttccaaacagaagcaagaggtggaaccctccacgtagcgaggggctccctgctggtcaccaccaagggcatttggttgccaagctccagctttgaagaaccaaattaagctaccatgaaaagaagaggaaaagtgagggaacaggaaggttgggattctctgtgcagagactttggttccccacgcagccctggggcttggaagaagcacatgaccgtactctgcgtggggctccacctcacacccacccctgggcatcttaggactggaggggctccttggaaaactggaagaagtctcaacactgtttctttttcagaa

SEQ ID NO: 6690 - DNA, 2952 bp, Homo sapiens
cgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaatt

SEQ ID NO: 6691 - DNA, 2754 bp, Homo sapiens
gcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagaaataccttgtaactgtaatttcctgaggctgcatatccacagggccaactcaggggacacacagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattca

SEQ ID NO: 6692 - DNA, 3124 bp, Homo sapiens
gaggaaggacccgcgctctgcggcctcccggggaccccgcagcgccccccgcttccctcggcggcgccggaagccgccggctggtcccctccccgcggcgcctgtagccttatctctgcaccctgagggccccgggaggaggcgcgggcgcgccgggagggaccggcggcggcatgggccgggggccctgggatgcgggcccgtctcgccgcctgctgccgctgttgctgctgctcggcctggcccgcggcgccgcgggagcgccgggccccgacggtttagacgtctgtgccacttgccatgaacatgccacatgccagcaaagagaagggaagaagatctgtatttgcaactatggatttgtagggaacgggaggactcagtgtgttgataaaaatgagtgccagtttggagccactcttgtctgtgggaaccacacatcttgccacaacacccccgggggcttctattgcatttgcctggaaggatatcgagccacaaacaacaacaagacattcattcccaacgatggcaccttttgtacagacatagatgagtgtgaagtttctggcctgtgcaggcatggagggcgatgcgtgaacactcatgggagctttgaatgctactgtatggatggatacttgccaaggaatggacctgaacctttccacccgaccaccgatgccacatcatgcacagaaatagactgtggtacccctcctgaggttccagatggctatatcataggaaattatacgtctagtctgggcagccaggttcgttatgcttgcagagaaggattcttcagtgttccagaagatacagtttcaagctgcacaggcctgggcacatgggagtccccaaaattacattgccaagagatcaactgtggcaaccctccagaaatgcggcacgccatcttggtaggaaatcacagctccaggctgggcggtgtggctcgctatgtctgtcaagagggctttgagagccctggaggaaagatcacttctgtttgcacagagaaaggcacctggagagaaagtactttaacatgcacagaaattctgacaaagattaatgatgtatcactgtttaatgatacctgtgtgagatggcaaataaactcaagaagaataaaccccaagatctcatatgtgatatccataaaaggacaacggttggaccctatggaatcagttcgtgaggagacagtcaacttgaccacagacagcaggaccccagaagtgtgcctagccctgtacccaggcaccaactacaccgtgaacatctccacagcacctcccaggcgctcgatgccagccgtcatcggtttccagacagctgaagttgatctcttagaagatgatggaagtttcaatatttcaatatttaatgaaacttgtttgaaattgaacaggcgttctaggaaagttggatcagaacacatgtaccaatttaccgttctgggtcagaggtggtatctggctaacttttctcatgcaacatcgtttaacttcacaacgagggaacaagtgcctgtagtgtgtttggatctgtaccctacgactgattatacggtgaatgtgaccctgctgagatctcctaagcggcactcagtgcaaataacaatagcaactcccccagcagtaaaacagaccatcagtaacatttcaggatttaatgaaacctgcttgagatggagaagcatcaagacagctgatatggaggagatgtatttattccacatttggggccagagatggtatcagaaggaatttgcccaggaaatgacctttaatatcagtagcagcagccgagatcccgaggtgtgcttggacctacgtccgggtaccaactacaatgtcagtctccgggctctgtcttcggaacttcctgtggtcatctccctgacaacccagataacagagcctcccctcccggaagtagaattttttacggtgcacagaggacctctaccacgcctcagactgaggaaagccaaggagaaaaatggaccaatcagttcatatcaggtgttagtgcttcccctggccctccaaagcacattttcttgtgattctgaaggcgcttcctccttctttagcaacgcctctgatgctgatggatacgtggctgcagaactactggccaaagatgttccagatgatgccatggagatacctataggagacaggctgtactatggggaatattataatgcacccttgaaaagagggagtgattactgcattatattacgaatcacaagtgaatggaataaggtgagaagacactcctgtgcagtttgggctcaggtgaaagattcgtcactcatgctgctgcagatggcgggtgttggactgggttccctggctgttgtgatcattctcacattcctctccttctcagcggtgtgatggcagatggacactgagtggggaggatgcactgctgctgggcaggtgttctggcagcttctcaggtgcccgcacagaggctccgtgtgacttccgtccagggagcatgtgggcctgcaactttctccattcccagctgggccccattcctggatttaagatggtggctatccctgaggagtcaccataaggagaaaactcaggaattctgagtcttccctgctacaggaccagttctgtgcaatgaacttgagactcctgatgtacactgtgatattgaccgaaggctacatacagatctgtgaatcttggctgggacttcctctgagtgatgcctgagggtcagctcctctagacattgactgcaagagaatctctgcaacctcctatataaaagcatttctgttaattcattcagaatccattctttacaatatgcagtgagatgggcttaagtttgggctagagtttgactttatgaaggaggtcattgaaaaagagaacagtgacgtaggcaaatgtttcaagcactttagaaacagtacttttcctataattagttgatatactaatgagaaaatatactagcctggccatgccaataagtttcctgctgtgtctgttaggcagcattgctttgatgcaatttctattgtcctatatattcaaaagtaatgtctacattccagtaaaaatatcccgtaatt

SEQ ID NO: 6693 - DNA, 3404 bp, Homo sapiens
ctcctcaccctcccacagggtcccagggccgatccaggcctgcgggccaggaatgtgctaacggggcaacttgggccttgctggtccacgcaggcacctgtggactttgagaggggactgggtggggaggggcggggaggggcggggcggggcggtgccgcagagtgcagggcgggcggggccaggccagcagggagtgagcttgtctggccgcctcgcctcggagccactgcactgctggctgcagacacaggctgcaccatgaagccagccctcctgccctgggccctgctgctgctggcgacagccctcggcccgggccccggacccacagcagatgcccaagagagctgctccatgcgctgtggcgccctggacgggccatgttcctgccacccgacgtgctctggccttggcacctgctgcttggatttccgggacttctgcctggagatattgccctactcaggatccatgatgggcggcaaggactttgtggtgcggcacttcaagatgtccagccccacagacgccagtgtgatctgcaggtttaaggacagcatccagaccctcggccatgtggactcctccgggcaagtgcactgtgtgtcacctctgctctatgagagcggccgcatccccttcactgtgtcactggacaacggccactccttccctcgtgcgggcacctggctggctgtgcaccccaacaaagtgtcaatgatggagaagagcgagttggtgaacgagacgcgttggcaatactacggcaccgccaacacctcaggcaacctcagcctgacctggcatgtcaagtcgctgcccacgcagaccatcaccatcgaactgtggggctacgaggagacaggaatgccctactcacaggagtggactgcaaagtggtcgtacctgtaccccctggccacacacatccccaactccggctctttcactttcaccccaaaacctgctcctcccagctaccagagatggcgagtgggtgcacttcggatcatcgacagcaaaaattacgcagggcagaaggacgtgcaggcgctctggaccaacgaccacgcactggcctggcacctgagcgatgacttccgagaggaccctgtggcctgggcacgaactcagtgccaggcctgggaggagctggaggatcagctgcccaacttcctggaggagctgccggactgcccctgcaccctgacccaggcccgggctgactccggccgcttcttcacggactacggctgtgacatggagcagggcagcgtgtgcacctaccaccccggggccgtgcactgtgtgcgttctgtgcaggccagcctccggtacggctcaggtcagcagtgctgctacacagcggacgggacgcagctcctgacagctgactccagcggcggcagcactcccgaccgcggccatgactggggcgcacccccgttccgcacgccaccccgagtgcccagcatgtcccactggctctacgatgtcctcagcttctattactgctgcctctgggcacccgactgcccccgctacatgcaacggcggccctccaatgactgccgcaactaccggcccccaagactggcctccgccttcggagacccacactttgtgaccttcgacggcaccaacttcacattcaatgggcgcggagagtacgtgctgctggaggcagcgctgaccgacctgagggtgcaggcgcgggcccagcccgggacgatgtccaacggcacggagacccgtggcactgggctgaccgcagtggccgtccaggagggcaactcagatgtggtggaagtcaggctggccaacaggaccggaggtctggaggtgctgctgaaccaggaggtgctgagcttcaccgagcagagctggatggacctgaaaggaatgttcctgtcggtggctgccggggacagggtctccatcatgctggcatcaggggccggcctggaggtcagcgtgcagggcccgttcctgagtgtgtccgtcctgctgcctgagaagttcctcacccacacccacggcctcctcgggacactcaacaacgaccccaccgacgacttcaccctgcacagcgggcgcgtcctgcccccaggcaccagtccccaggagctgttcctgtttggggccaactggaccgtgcacaatgcgtcctccctgctcacctacgattcctggttcctggtccacaacttcctgtaccaacccaagcacgaccccaccttcgagcccctcttccccagtgagaccaccctcaaccccagcctggcacaagaggcagccaaactatgtggggacgatcatttctgcaactttgatgtggcagccactgggagcctgagcacgggcactgccactcgggtggcccaccagctgcaccagcgtcgcatgcagagcctgcagccagtggtgtcctgtggctggctggccccacctcccaacggacaaaaggagggcaacaggtacctggcgggttccaccatctacttccactgtgacaacggctacagcctggccggggcagagaccagcacctgccaggctgacggcacctggtcctcacccaccccgaagtgccagccaggacgcagctacgcggtgctgttgggcatcatctttgggggcctcgcggtggtggcggcggttgcgctcgtctatgtgctgctgcgccgcaggaagggcaacacgcacgtctggggtgcacagccctgatgggagcagcttggctgtgagcaccaggccaagactcctgagaacaggcagcccagtcctgcgactcccgcatccccaggaccagacacctgggacctggatacttgatacctgggcatttaaccccctactctgtcatctcagaccccaggcaggaggcccagtgttccaacacccaagccccgtgctagcagcgctccgtgctcttccccaaatactcacggctctaattccccaaacctgaaacttcataccctgggattctaatacctatgtcctgagccctgacactcccacacctgagcctcagattccaatagctcactccctagagcctgacgccggggcccctgacccctgagcctcagattccaatacctcactccccagagcctgatgccggggcccctgacccctgatctacggaggcctgctcccggaccgtgcgggcaccagtgcagtgctgccttggttcctggacccctgggcccatcctgggaccccagatggggtaaggagaggccccagaaccccaaagcagacagcgagacccccagcggcagaggcctccctcggcactccaggcttataatttcgaactcttctggaaggtcactcaggaacaccctccctgcctgtgcaaagagaaaacaagcgccttgtttccttccctg

SEQ ID NO: 6694 - DNA, 1112 bp, Homo sapiens
atgaaaaacataggccttgtgatggaatgggaaattccagagataatttgcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaact

SEQ ID NO: 6695 - DNA, 1195 bp, Homo sapiens
ctggcagaccccgccaagcgcctcggagcgcgcaggatgcgctgggcggccgccaccctccgtggcaaggcgaggccccgggggcgggccggggtcaccacgcctgccccagggaaccgcacaggcacgtgcgctaagctgcggctacccccgcaagcaaccttccaagtccttcgtggcaatggtgcttccgtggggaccgtgctcatgttccgctgcccctccaaccaccagatggtggggtctgggctcctcacctgcacctggaaggggagcatcgctgagtggtcttcagggtccccagtgtgcaaactggtgccaccacacgagacctttggcttcaaggtggccgtgatcgcctccattgtgagctgtgccatcatcctgctcatgtccatggccttcctcacctgctgcctcctcaagtgcgtgaagaagagcaagcggcggcgctccaacaggtcagcccagctgtggtcccagctgaaagatgaggacttggagacggtgcaggccgcataccttggcctcaagcacttcaacaaacccgtgagcgggcccagccaggcgcacgacaaccacagcttcaccacagaccatggtgagagcaccagcaagctggccagtgtgacccgcagcgtggacaaggaccctgggatccccagagctctaagcctcagtggctcctccagctcaccccaagcccaggtgatggtgcacatggcaaaccccagacagcccctgcctgcctctgggctggccacaggaatgccacaacagcccgcagcatatgccctagggtgaccacgcagtgaggctggtgcccatgctccacactgggaggccaggctgaccccaccagccagtcagctacaactccacatcaactccacatgcgcccagctcgagactgatgagtggaatcagcttccaggtgtagggaccccttgaggggccgagctgacatccaaggctgaggaccccagtggggagtgttctgttccggcatatcctggccgtaacgatttttatagttatggactacttgaaaccactactgagggtaatttactagctgtggcctcccactaactagcattcctttaaagagactgggaaatgttttaagcaaatctagttttgtataataaaataagaaaatagcaataaacttcttttcagcaactacagaaaa

SEQ ID NO: 6696 - DNA, 892 bp, Homo sapiens
gggagctggagccgagcgccgccgccgaagcttccgtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataa

SEQ ID NO: 6697 - DNA, 727 bp, Homo sapiens
tgccacattgtgagattcccagagtgaaatgtataggcccagggaaaagtgtcttcgcggccccgagacgcggggaggctctagactttcctgtggtgggcacagctgctgaatcccggggaccggcgcggagccaatactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgtacacttgaccagagacctgctgggctttgagggatgcccagagtgccccccacccccaggcttcaaggaagagagccaagagtttgctcaacaagtgactcctttaaggtctctgactcatgcaaacccctggtccagcggccctctctgcatacccaagtcatggtcctagtgcagctgaattgagctcctggagccctcatttggttcatgtcgctgtagtgctgtgctctgtgccagcaggtggaaacagatgctttctgactgactcactgatttgtagtgttaagtcccttagttttattgagaaacattttcttacatggtagagtgaaagcttttcattcaatgctacatctaaaattcacaatttcaaactgcgcttaatctgtaagcaaagtccca

SEQ ID NO: 6698 - DNA, 3480 bp, Homo sapiens
caggtaagaccgacagtcccggaagggtcttccattccgaggaggcgcgcgcaggccggggagggggagttggtgcctggtgcagctccccaagggagaattttttttttttttttgacagcgcagagaaatctcactggggactggggcagtaggatcgatcccaatcccgaggaaaaccagagaagtagctgggggagacggtgccacattgtgagattcccagagtgaaatgtataggcccagggaaaagtgtcttcgcggccccgagacgcggggaggctctagactttcctgtggtgggcacagctgctgaatcccggggaccggcgcggagccaatgtgcgctaacccctgccctccctcctgtcctccatcccccagcacgcgcagcatcccacggcggctgttactcagtgcacccggctcgggggaaggcgggggacctcgccgtgggaaagggggcgggggccgcgcgggggaggaaccaggatggagcctgggaagccgaggcgccgggtcccagagcggaggagggggagcgtggcccccgagcccggacagactggcttattgtggtgttccgcttctggttgcagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacagtttgaa

SEQ ID NO: 6699 - DNA, 1056 bp, Homo sapiens
gtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaaggaggaagacctgaacatcttttccctgtcctttatttcccacacatcaggttggcagctgctgtgctttatttttgccctgtgttaaagtcctctcccaccccagcacctacctgttcctcaactagcaccaccacatctctgttctaaatgttgttctcctgcaataaaggacgtttgaattaaa

SEQ ID NO: 6700 - DNA, 502 bp, Homo sapiens
gggagctggagccgagcgccgccgccgaagcttccgtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgtacacttgaccagagacctgctgggctttgagggatgcccagagtgccccccacccccaggcttcaaggaagagagccaagagtttgctcaacaagtgactcctttaaggtctctgactcatgcaaacccctggtccagcggccctctctgcatacccaagtcatggtcctag

SEQ ID NO: 6701 - DNA, 3025 bp, Homo sapiens
gggagctggagccgagcgccgccgccgaagcttccgtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacagtttg

SEQ ID NO: 6702 - DNA, 1775 bp, Homo sapiens
acagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagctgcttctgcaagactggagcctgcatgaccccaagcatgggtgaaaatgtctatggcccagggaacagaggaggtgacctatatggtggagaggagaccctagaattggcaaaggactgaaaatacaccccgtgggcgcagggctgctgacctaattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcgggga

SEQ ID NO: 6703 - DNA, 1775 bp, Homo sapiens
ctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaagcccaagtctgtccactacctccaatggtgagtcacggagatttcgtctgccacccgcggccttgtgagcgctacaaccacggaactgtggtggagttttactgcgatcctggctacagcctcaccagcgactacaagtacatcacctgccagtatggagagtggtttccttcttatcaagtctactgcatcaaatcagagcaaacgtggcccagcacccatgagaccctcctgaccacgtggaagattgtggcgttcacggcaaccagtgtgctgctggtgctgctgctcgtcatcctggccaggatgttccagaccaagttcaaggcccactttccccccagggggcctccccggagttccagcagtgaccctgactttgtggtggtagacggcgtgcccgtcatgctcccgtcctatgacgaagctgtgagtggcggcttgagtgccttaggccccgggtacatggcctctgtgggccagggctgccccttacccgtggacgaccagagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctg

SEQ ID NO: 6704 - DNA, 5005 bp, Homo sapiens
gccaagggtcccccagacgggcgggggctccttgcggccggctagctactctccccgcctccctgcgccctcgccctccgccccgctgtacccgcagagcgcgcggcccagcgcagccccttttggcaccgaggtttccaggtgcccagcgcgaaggcggagccgggttacagccgcctcctcggcgccacagagaagacccccgggagttcggcggcccaggcgctccggctctgcgtcccgagcctcccccggctctccgcgctcctccctctcggcgcgcccggcgcgaagcctgcgattcgtgagccgagcgcagagcgcagagccgagtggcgcacgctgggcagtggcctgggcaaccccaaacgcagccagagccctcacccgagtccgctggcccgcgcactcccggaccatgactgccgagggacccagcccgcctgcccgttggcacagacgcctccccgggctctgggcggcggcgctgctcctgctcggtctgccgcgcctttcggtgcgggcggatggaaagttctttgtgctggagtctcagaatggctctcagggcctacaactggaggctgctcggctttcctgcaagagcaggggcgctcacctggcatctgcagacgagctgcggagagtggtacaggattgctcctttgcggtgtgcaccactggctggctagcagatggtactcttggaacaactgtgtgtagcaaaggaagtggagaacagcaaatcatgagagctgtcgatgtgagaattgagagcaacccagttcctggtggcacatacagtgccctttgtattaaggatgaagagaagccgtgtggagacccgccttcgttcccacacaccatcctgcagggccgcaccggcttggaaatgggggatgaactgctgtacgtgtgtgccccaggccacatcatgggccaccgggagaccgccttcaccttgctatgtaacagctgtggggagtggtacggcctggtgcaggcctgtgggaaagatgaggctgaggcacacattgactatgaagataacttccctgatgacagatctgtgtcattcagagagctcatggaggattcccggacagaggcagatgaggacaggggtcagggagactcctctgaggaggctccaaaacaggaccgtctggtctccatttctgtggggagagaaaacatagcccgggataaagtctttgtgccaaccacaggcttgcctggtgctgggagcagtgtccccgcagattcaccaggatcacggctgctccagaagcacttgttctggtttcctgctgaggctttccacaagcctgggttggaaaaggaggtggatgatgacaccaaaaagcagttttctgctggagacaaccacagtggtgtaaaattggtcccaggtgaacctgaaaccaaggtgatctacggcaacactgatggtccctcggggccatttgtgggcaagaatgacagcaaggcaggagatccagtggtgagcagcagtgatgagtcctggttagatggctaccctgtgacagagggggcttggaggaagacagaggcagaagaggaagaagatggggacagaggggatgggtcagtagggctggatgaaaacgtcctagttactcctgatcagcccattcttgtggaagttaagaagcccaagagtagcaccctcacaccaagcgagggcatgacccatagttcagttcttccatctcaaatgctagatgtggaagctttggcgctcagacccgtgaatgcttccgagactgagggcattggggatggtgacttgacgaagtaccagtcaactctaccctggagattcatcacagaggaatctcccatggccaccctgtcctatgagctcaccagctccaccctggagatattaacagtgaacactgtcaagcagacacctaaccacatcccctcaacgatcatggcaaccacccagcctccagtagaaaccactgttcctgagatccaggatagcttcccatacctgctgtctgaagacttctttggacaggaaggccccgggccaggtgcaagtgaggagcttcatcccaccttggagtcgtgtgtgggggacggatgtcctggcctcagcagaggccctgtgatcgccaccattgtcaccgtcctgtgcctactgctgctcctggcaggtgtggggatggtgtggggctaccgcaagtgccagcacaagagctctgtgtacaagctgaatgttggccagcggcaggctcggcactaccaccagcagatcgagatggagaaggtctaggcacctttggagtgggttctcccaaagccacttgggaggaaaataactgtgacacatcacacgataattcactagagcatgacgcaggtggactgaggctcatcattttttcctcagccctttgttttataggctgagaagtgtctctggagcacctgggagggcagggaggctttggtgacatcatcactcatgtcaatgtctcctccaccatctgccctggaattgactacactaatcccagacctgtgcttgggccctgtttccagtgtgaggtcaaaaatcgcctcttccttcatcacagtattatctttttttttttgagacagagtctcatgctgttgcccaggctggagtgcagtgtcccgatctgagctcactgcaacctctgcctcccaagttcaagcaattctcctgcctcagcctcccaagtaggtgggattacaggcatgcaccaccatgcccagctaatttttttatatttttagtagagatggagtttcaccatgttggccaggctggtcaagaactcctgacctcaagtgatctgccctccttagcctcccaaagtgctaggattccaggtgtgagccacatcacagtattacctttttgaagaaagaaaatcaccagcttcatgccctgaaattttataaatagtcatgataaaccaagtgtatgagagcagtattatctaggacatggatattgaattattgggagaggaatatggaagaataatgggttgtttccttttaatgttgtgatgttgctgagggcagatgaaccaagagccaggacacagtctagaagctttgaggtttcttttttcattgtttcttgaaattagaatttaagactgacattttgttgggggagttgaggagtgaagaaacacacatccccctctgttccctccattctgtgggacagtctgtcatttattttattttattttcaatatttcatggttaaggatttgccattattttttaaaaacaaagttagctttgtaccagtaagtaccatttcctctcagaagcagtggcctagttgtccttgaccagtctgtgcctaggaatgtcttggaatttttgccaggactaacaaaactcagtccttggtttcctctctcaggattaaccatttctctgaactccagtaagagagaatgacacgggagaaaaaaaaaagaaatgttttcagagggccgaacaccaggttatcaagtatgggcacatacttgatggagaagcagaagaatctgtgaaagaatatgaaatgatctgtgctgatctgttctctagtgtggaaactgggagctctgtggaaacagaatccatcctgtctgttgggtaacccatttcgtagcatctaaatcatcttagggtggctcagcgaggatggtttatggcagtggttctcaaagtgtggtcctcagaccagtagcatcagcgtcacctgggaatttgttggagatgcaaattctctagtcccaccctggactcaggaaacaggaaccctgggagtagggcccagttctgtttttaacaagccctccaggtgattttgatatgcactcaagtttgagagcctgttggtttataataatctcaaatgtgaacttcgaggccagctgaagccctaaaggcacagatgagtatgtggtgtgtgttgtgtggaagtcaggcatggctgtgtgcagctgaggtggcatttgaagctgcctaaatgccacctgcaatagtctcctgtatgttggcacagaaatgaaacatgttatatttttctaatatgaatcaccttcttagaaatagttatcagtggtaaaaagtgatgaatgcaacacatttattttgagacaccatagcagtctaagtgtttttgtgtggtagagggaaatcctgatcttttttatgattgaaaaattgttggtggtgttttacctaaggaaaaaaaacattcgcaacatgttttctaccctgccacctcttttcagcaagctttggaaaagtaataggcgaagtagctgtaaagagaggcagcataatcaaagatcttattccccatagttgggtaaaataaagcctgaaggtaccaactagaatacctgtgcatcagacgaagtcaagaacaataggaataaaatgctttctgcatgtagccaaagcaaaacataatagaataaaagccagagactgtatatatttataaattagatcctaatctactgcaagataacttttctatttttaactatataaaataacctctgtctcagcattgggactgtgttagcaactattattgtggaataacccagaacattggatttataccaacaaataggcaatattaatacagtgtattaataaatttattacaaattattaatacagtgtattaataaatttattacaaattattaatacaggtaaatgttttatttgtagacatggactgtgaaataaacccaacacatcagtttttaagttcttattggtgtggtatcctctaaattaatgttatagaatctaaaaattcatgttgaaagggaatgattaaaacaatgtaaatctaaattgtatgtcatgcatgttttgagaatggtgaatgtttaatgctcatgaaaattgggggagggggttctattaacacaaagcttctgagatatttaaaataaataattattgcccc

SEQ ID NO: 6705 - DNA, 4195 bp, Homo sapiens
ggaaatgaagggtctgctcgccgtagtatggaggcgggcagaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctctacaaggtggccctgcagtggatggtaaagtcacgggtcattagcgagctacaggaggcctgctgggacatggtatctgccatggcgggggacatcatcctgctattggactctgacaatgacggcatccgcacccacgccatcaagtttgtggagggcctcattgtcaccctgtcaccccgcatggctgactcagagataccccgacgccaggagcatgatatcagcctggaccgcatccctcgtgaccacccctacatccagtacaacgtgctatgggaagagggcaaggcagccttggagcagctgcttaagttcatggtgcaccctgccatctcctccatcaacctgaccacagcgctgggctcccttgccaatatcgcccgccagagacccatgttcatgtctgaggtgatccaggcctatgaaactctgcatgccaacctgcccccgacgctggccaaatcgcaggtgagcagtgtgcgtaagaatctgaagctgcacctgttgagtgtgctgaagcacccggcttccttggagttccaggcccagatcaccaccctgctggtggacctgggcacacctcaggccgagatcgcccgcaacatgccgagcagcaaggacacccgcaagcggccccgcgatgactcggactccacactcaagaagatgaagctggagcccaacctgggggaggacgatgaggacaaagacttggagccaggcccgtcggggacctcgaaggcctcagcgcagatctccggccagtcagacacggacatcacagctgagttcctgcagcctctgctgacgcctgataatgtggctaatctggtcctcatcagcatggtgtacctacccgaggccatgccagcctccttccaggccatctacacccccgtggagtcagcaggcacggaagcccagatcaagcacctggctcggctcatggccacacagatgacagctgccggactgggaccaggtgtagagcagaccaaacagtgcaaggaggagcccaaggaggagaaggtggtgaagacagagagcgtcctgatcaagcggcgcctgtcagcccagggccaagccatctcggtggtgggttccctgagctccatgtcccccctggaggaagaggcaccgcaggccaagaggaggccagagcccattatccctgtcactcagccccggctggcaggcgctggtgggcgcaagaaaattttccgtctcagcgacgtgctgaagccccttaccgatgcccaggtggaagccatgaagctgggcgctgtgaagcggatcctgcgggctgagaaggctgtggcctgcagcggggcagcccaggtccgcataaagatcctggccagcctggtgacacagttcaactcgggcctgaaggcggaggtcctgtccttcatcctggaggatgtgcgggcccgcctggacctggccttcgcctggctctaccaggagtacaacgcctacctggccgcaggtgcctcgggctccctggacaagtatgaggactgcctcatccgcctgttgtctggcctgcaggagaaaccagaccagaaggatgggatcttcaccaaggttgtgctggaggcgccactcatcacagagagtgccctggaggtggtccgcaagtactgcgaggatgagagtcgcacctatctgggcatgtccacacttcgagacctgatcttcaagcgcccgtcccgccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagttactgaaaa

SEQ ID NO: 6706 - DNA, 2326 bp, Homo sapiens
gacgaacggaagatggcggcggcggcggcggcggagtgtaggaagaggcactgctgagggggcgcgaggggaacggaggccagagctgcgctgacagcagccatggcgagcggcagtggagacagcgtcacccgtcggagcgtggcatcacagtttttcactcaagaggaggggccgggcatcgatggcatgaccacctcagagagggtggtggatcttctgaaccaggcggcgctgatcaccaatgactcaaagatcacagtgctcaaacaggtccaggagctgatcatcaacaaagaccccacactactggacaacttcctggatgagatcatcgcattccaagcagacaagtcaatcgaagtgcgaaaatttgtcatcggcttcatcgaggaggcatgcaagcgagacattgagttgctgctgaaactcattgcaaacctcaacatgctcttgagggacgagaatgtgaacgtggtgaagaaggctatcctcaccatgacccagctcccagttccagtacctgcatgtcctcctcgacctcagctcccatgagaaggacaaggtgcgctcccaggccctgctgttcatcaaacgcatgtatgagaaggagcagctgcgggagtatgtggagaaatttgccctcaactacctgcagctcctggtgcaccccaacccaccgtctgtgctgtttggagctgacaaggacacagaggtggcagcaccctggacggaggagacagtgaagcagtgtctgtacctctacctggccctcctgcctcagaaccacaagctgatccacgaactggcggccgtgtacactgaagccatcgccgacatcaagcggacggtgctgagggtcattgagcagccgatccgaggaatgggcatgaactccccggagctgctcctgctggtggaaaattgtcccaagggagcagagacactggtcacgagatgtctgcacagcctcacagacaaagtcccaccctccccagagctggtgaagcgggtccgggatctctaccacaagcgactgccagacgtccgcttcctcatcccggtgctcaatgggctggagaagaaagaggtgatccaggccctgcctaaactcatcaaactcaaccccatcgtggtgaaggaagtcttcaaccgcctgctgggcacccagcatggtgagggaaactcagccttgtccccgctgaaccctggagagctcctgatcgcattacacaacattgactccgtgaagtgcgacatgaaatccatcatcaaagccaccaacctgtgctttgcggagcggaacgtgtacacgtcagaggtgctggccgtggtgatgcagcagctgatggagcagagccccctgcccatgctgctcatgaggaccgtcatccagtccctgaccatgtacccccgcctggggggcttcgtcatgaacatcctgtcccgcctcatcatgaagcaggtgtggaagtaccccaaggtgtgggagggcttcatcaagtgctgccagcgcacaaagccccagagcttccaggtcatcctgcagctgccgccccagcagctgggagccgtctttgacaagtgcccagagctccgggagcccctgctggcccatgtccgctccttcaccccccaccagcaagctcacatccctaactccatcatgaccatcttggaggccagcggcaagcaggagccagaggccaaggaggcgcctgcggggcccttggaggaggatgatctggagcccctgaccttggccccggccccagcaccccggccccctcaggacctcatcggcctgcgactggcccaggagaaggccttaaagcggcagctggaggaggaacagaagctgaagccgggaggagtgggagccccctcctcttcctccccctctccctctccgtcggcccggccaggcccgcccccgtctgaggaagccatggatttccgggaggaggggcctgagtgcgagaccccgggcatcttcatcagcatggatgacgactcggggctgaccgaggccgcgctgttggactctagtctcgagggccccctacccaaggagacggcagcgggcgggctgaccttgaaggaggagcggagcccccagaccctcgcacctgttggagaagatgctatgaagactcccagcccggctgccgaggacgccagggaacccgaggccaaggggaacagctgacggggctcgagggggaaagggggtgggacagggactcggggctgggggacggggcggggcttgacctgcgggtgctttgccttaaaaagaaataaaagatgtgaacttgggcaagtt

SEQ ID NO: 6707 - DNA, 4095 bp, Homo sapiens
tctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaa

SEQ ID NO: 6708 - DNA, 1461 bp, Homo sapiens
gaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccaca

SEQ ID NO: 6709 - DNA, 4601 bp, Homo sapiens
atgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccggg

SEQ ID NO: 6710 - DNA, 4339 bp, Homo sapiens
gggggaagaggaaagcctgcctatgggcaatgacctttaacccatctttccccccagctagccccttctggggtgggtgggcaccagggacctagcctccctggatctttggtgtccttcattactggggttttactgaccctctcagtcatgctcccctgctgactgccagccccagtcatgggcctaaggcctcccaccccatccccctcagggggctcctgctcaggttccttgccccctccttcccgctgccagcctctccgccgtcgctgctcttcctgctgctttccgggggaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcct

SEQ ID NO: 6711 - DNA, 5916 bp, Homo sapiens
cctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 6712 - DNA, 3929 bp, Homo sapiens
cccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcgtggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagagaggcagcttccccccttgggtccaacaaacccgcgtgtgacgctggccccaccgtggaatggcctggcccccccagcccc

SEQ ID NO: 6713 - DNA, 5916 bp, Homo sapiens
cctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 6714 - DNA, 4095 bp, Homo sapiens
tctcggctgccgctgctgccgttggctcttattctcctcctcctcctcctctctcctcctctctgcttctctctgctcctctctcctcctctctcctcctcctcctcctccacctcctcctccttctccccctctttctccccctctttctctcttctttctcccccgtccccccgccccctccccccaggcctgatgagcaggtctcgagcctccatccatcgggggagcatccccgcgatgtcctatgcccccttcagagatgtacggggaccctctatgcaccgaacccaatacgttcattccccgtatgatcgtcctggttggaaccctcggttctgcatcatctcggggaaccagctgctcatgctggatgaggatgagatacaccccctactgatccgggaccggaggagcgagtccagtcgcaacaaactgctgagacgcacagtctccgtgccggtggaggggcggccccacggcgagcatgaataccacttgggtcgctcgaggaggaagagtgtcccaggggggaagcagtacagcatggagggtgcccctgctgcgcccttccggccctcgcaaggcttcctgagccgacggctaaaaagctccatcaaacgaacgaagtcacaacccaaacttgaccggaccagcagctttcgccagatcctgcctcgcttccgaagtgctgaccatgaccgggcccggctgatgcaaagctttaaggagtcacactctcatgagtccttgctgagtcctagcagtgcagctgaggcattggagctcaacttggatgaagattccattatcaagccagtgcacagctccatcctgggccaggagttctgttttgaggtaacaacttcatcaggaacaaaatgctttgcctgtcggtctgcggccgaaagagacaaatggattgagaatctgcagcgggcagtaaagcccaacaaggacaacagccgccgggtagacaatgtgctaaagctgtggatcatagaggcccgggagctgccccccaagaagcggtactactgtgagctctgcctggatgacatgctgtatgcacgcaccacctccaagccccgctctgcctctggggacaccgtcttctggggcgagcacttcgagtttaacaacctgccggctgtccgtgccctgcggctgcatctgtaccgtgactcagacaaaaagcgcaagaaggacaaggcaggctatgtcggcctggtgactgtgccagtggccaccctggctgggcgccacttcacagagcagtggtaccctgtaaccctgccaacaggcagtgggggatctgggggcatgggttcgggagggggagggggctcggggggtggctcagggggcaagggcaaaggaggttgcccggctgtgcggctgaaagcacgttaccagacaatgagcatcttgcccatggagctatataaagagtttgcagagtatgtcaccaaccattatcggatgctgtgtgcagtcttggagcccgccctgaatgtcaaaggcaaggaggaggttgccagtgcactagttcacatcctgcagagtacaggcaaggccaaggacttcctttcagacatggccatgtctgaggtagaccggttcatggaacgggagcacctcatattccgcgagaacacgcttgccactaaagccatagaagagtatatgagactgattggtcagaaatacctcaaggatgccattggagaattcatccgtgctctgtatgaatctgaggaaaactgcgaggtagaccctatcaagtgcacagcatccagtttggcagagcaccaggccaacctgcgaatgtgctgtgagttggccctgtgcaaggtggtcaactcccactgcgtgttcccgagggagctgaaggaggtgtttgcttcatggcggctgcgctgcgcagagcgaggccgggaggacatcgcagacaggcttatcagcgcctcactcttcctgcgcttcctctgcccagcgattatgtcgcccagtctctttgggcttatgcaggagtacccagatgagcagacctcacgaaccctcaccctcattgccaaggtcatccagaacctggccaacttttccaagtttacctcaaaggaggactttctgggcttcatgaatgagtttctggagctggaatggggttccatgcagcagtttttgtatgagatctccaatctggacacgctaaccaacagcagtagctttgagggttacatcgacttgggccgagagctctccacactgcatgccctactctgggaggtgctgccccagctcagcaaggaagccctcctgaagctgggtccactgccccggctcctcaacgacatcagcacagctctgaggaaccccaacatccaaaggcagccaagccgccagagtgagcggccccggcctcagcctgtggtactgcgggggccatcggctgagatgcagggctacatgatgcgggacctcaacagctccatcgaccttcagtccttcatggctcgaggcctcaacagctctatggacatggctcgcctcccctccccaaccaaggaaaagccacccccaccaccgcctggtggtggtaaagacctgttctatgtaagccgtccacccctggcccgttcctcaccagcatactgcacgagcagctcggacatcacagagccagagcagaagatgctgagtgtcaacaagagtgtgtccatgctggacttacagggtgatgggcctggtggccgcctcaacagcagcagtgtttcgaacctggcggccgtaggggacctgctgcactcaagccaggcctcgctgacagcagccttggggctacggcctgcgcctgccggacgcctctcccaggggagtggctcatccatcacggcggctggcatgcgcctcagccagatgggtgtcaccacagacggtgtccctgcccagcaactgcgaatccccctctccttccagaaccctctcttccacatggctgctgatgggccaggtcccccaggcggccatggagggggcggtggccatggcccaccttcctcccatcaccaccaccaccaccatcaccaccaccgaggtggagagccccctggggacacctttgccccattccatggctatagcaagagtgaggacctctcttccggggtccccaagccccctgctgcctccatccttcatagccacagctacagtgatgagtttggaccctctggcactgacttcacccgtcggcagctttcactccaggacaacctgcagcacatgctgtcccctccccagatcaccattggtccccagaggccagccccctcagggcctggaggtgggagcggtgggggcagcggtgggggtggcgggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaa

SEQ ID NO: 6715 - DNA, 2903 bp, Homo sapiens
ttgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctctttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccacagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggtagttggaatgtgttggaggcagggcagtggattcaggggaggggtggggtgaggaaggagggctgaatgggaagagcatccttaggggtgagaggatatacatttccattttctcctctaaaatctggtagctttggccgggcacggtgactcatgcctgtaatcccagtgctttgggaggccgaggcaggcagatcacctgaggtcaggagtttgagaccagcctggccaacatggtgaaaccctgtctgtactaaaaatacaaaaagttagctgggtgcctgtaatcgcagctactcaggaggctaaggcaggagaattgcttgaacccgggaggtggagctttcagtgagccgagatcgcaccactgcactccagcctgggcaacagagcaagactccgtctc

SEQ ID NO: 6716 - DNA, 4416 bp, Homo sapiens
aggcggggctggagtggtggaaggggggtggcaggtctgcattgccgcttccctggtgccgggagcagtcgccgctgccgcctccgcccgcggccgggacccccgtcctcgcccgggactccttacccggggaacctagaccaggtctccagaggcttgtggaagagaagcaggcgacccttcctgagttatcctggcttagcctcccaatctggctccccttccccttcccattcccctgctccccctgtcccttccccatccacccaactgaactgggtataggtcaaagctcctctctttccttttccttcctaggcactcattggctaggacctgtttgctcttttttttgtgcccagagatactggaacacgcttcatctaagtaactgtggggaggggtctttttgactctacaagtccttgagcaaaaagctgaaaaagaagcaggaggtggagaagacccagtgaagtgccccaagccccatcatggaagagggcttccgagaccgggcagctttcatccgtggggccaaagacattgctaaggaagtcaaaaagcatgcggccaagaaggtggtgaagggcctggacagagtccaggacgaatattcccgaagatcgtactcccgctttgaggaggaggatgatgatgatgacttccctgctcccagtgatggttattaccgaggagaagggacccaggatgaggaggaaggtggtgcatccagtgatgctactgagggccatgacgaggatgatgagatctatgaaggggaatatcagggcattccccgggcagagtctgggggcaaaggcgagcggatggcagatggggcgcccctggctggagtaagggggggcttgagtgatggggagggtccccctgggggccggggggaggcacaacgacggaaagaacgagaagaactggcccaacagtatgaagccatcctacgggagtgtggccacggccgcttccagtggacactgtattttgtgcttggtctggcgctgatggctgacggtgtggaggtctttgtggtgggcttcgtgctgcccagcgctgagaaagacatgtgcctgtccgactccaacaaaggcatgctaggcctcatcgtctacctgggcatgatggtgggagccttcctctggggaggtctggctgaccggctgggtcggaggcagtgtctgctcatctcgctctcagtcaacagcgtcttcgccttcttctcatcttttgtccagggttacggcactttcctcttctgccgcctactttctggggttgggattggagggtccatccccattgtcttctcctatttctccgagtttctggcccaggagaaacgaggggagcatttgagctggctctgcatgttttggatgattggtggcgtgtacgcagctgctatggcctgggccatcatcccccactatgggtggagttttcagatgggttctgcctaccagttccacagctggagggtcttcgtcctcgtctgcgcctttccttctgtgtttgccattggggctctgaccacgcagcctgagagcccccgtttcttcctagagaatggaaagcatgatgaggcctggatggtgctgaagcaggtccatgataccaacatgcgagccaaaggacatcctgagcgagtgttctcagtaacccacattaagacgattcatcaggaggatgaattgattgagatccagtcggacacagggacctggtaccagcgctggggggtccgggccttgagcctaggggggcaggtttgggggaattttctctcctgttttggtcccgaatatcggcgcatcactctgatgatgatgggtgtgtggttcaccatgtcattcagctactatggcctgaccgtctggtttcctgacatgatccgccatctccaggcagtggactacgcatcccgcaccaaagtgttccccggggagcgcgtagagcatgtaacttttaacttcacgttggagaatcagatccaccgaggcgggcagtacttcaatgacaagttcattgggctgcggctcaagtcagtgtcctttgaggattccctgtttgaagagtgttattttgaggatgtcacatccagcaacacgtttttccgcaactgcacattcatcaacactgtgttctataacactgacctgttcgagtacaagtttgtgaacagccgtctgataaacagtacattcctgcacaacaaggagggctgcccgctagacgtgacagggacgggcgaaggtgcctacatggtatactttgtgagcttcctggggacactggcagtgcttcctgggaatatcgtgtctgccctgctcatggacaagatcggcaggctcagaatgcttgctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatcccagttttgagatgaagctgtactccccatttcccactgcccttgactttgcacaagagaaggctgagccccatccttctccccctgttagagaggggcccttgcttccctgttccaggggttccagaataggcttcctgccttccccatcattccctctgcctaggccctggtgaaaccacaggtatgcaattatgctaggggctggggctctggtgtagaccatggaccaaaagaacttcttagagtctgaagagtgggcctcgggtgccctctcacatctcctgttggatgctgggggagaagcaataaacctcagccctctggcctccactttcctctcaatttgggctgcaaatatgaagcctgaattttatgaaattagctttctgattcttatttattaatagattaagttctgaggcagctccgcaggactgtgtgtgaatgtgtatgtatacttacatatgtgtgtgcatgtgccatggggcggggggtatcactatactgtcctcaaatataagccaagggtaatttcagcggatgcacacacaaccctgcctcccacagttcctcccctaatctggtttctgtgttgagcctgggatggaggagccctaggccagcctgggataagagtcccacagtctagggagatctgagggcatccgacaaggcccatctccttccctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaatacaaaa

SEQ ID NO: 6717 - DNA, 11202 bp, Homo sapiens
cagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccc

SEQ ID NO: 6718 - DNA, 11279 bp, Homo sapiens
ggagctgcacgcggggctgccggggcggacgctgctctgcctgcatccggaggcggccgccagcggatttgccacccagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattaggtaatacatttaagaaggatatttatttctgttttgctctattcaaagaaacggaatgggatagttattctgtaaactaagtttgtatataactttatttgggtttaatttccacaactggtatctgcaaatattgccagcattttagccatattttgggagaacttggtgtttgaggtcccaggaaatgaggtctgatcaaatgaaatgcaagcacaatttcttacagccatttaactttctgttgggaggatgaattaacaaactcacattgtgcagtctgcttaatccaggcacttttctttgtgcaggtgtagtgagtagttacttctctcccttacacagatgacttgtgaaactcaagctcaccatcttcagtgctggcattttactttgccactacccaaaaacaatgtgagatgtgttcagtggcctctggtactctttgcaggcaagaatcaaacaacatggggactgagggaaggatggggaagtgtagccacagttcttccaaatgtaaatactttttgtttgttctagtggtaaaatgcaaatgcaatccatatttgttaggatggtcaggtctcatgagaaatctatgctatgtgtccagagcttttgaaacagagtccattggagtgggagttagggagtgtagtggatgccaaatatgtttttcttcagtgcttaagagaactgtttcctgaagtccagctttgaacataaacaggggtgtgggttgggggaggagcttaggacaaacctctctgatgaaggtcagcaatagactgaagtcttgactgcatggaagaggaaaaacatcagaactgtctgacaatggaggggacagtgagctacgcacaactgccagcggaggtgaacttgcacctgcccaggccggatgaacatcagcctgcaagaactagttgtttgagttgatttgcagtgctctcaatgggcaagtgccacattttccctggcagagatctccaaaaatttaaaacagaataataatggctatatcgagtgttttctcagtattggagaaatgcttaggtcctatgatagcttcgggacatctttctgtaattttcctcaattaacgggttggtaggggtaaatcttatgacacctttccaccgtcgatttgagatcagttttaatggttaaaatgtttactctccttctgtcaaccctcacctttttatttacacccctccctttttttctgtacagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaagaggtgtgcctatctgtgaagtttgtagtacatcatcctgaggtcatgtaacaagtaaaccccaacccagcgttccctcctacgttgtgttagttcattaaaactaaataataaaaataactgtaagaaaaccttaaggactggggttagagattattttcaggcactaaggtctcttctgtattccaaaattgattgaatcagctgggagaaacattgagaatcgcttccttcaacttttattttgcaacatggggaccttgagaggttaaacgatgtggcccagattacatgtaatgtgaggagtgggcgagaaggcctaaggtgatgctctcatgacagttctggggaagcctgcagtttggggaatgggacaatgtgacaaatactcgccattccctgagaccattcattgactattcccttgatggctttactataatgagaggaagcatcagtttaaacataaaaagattagtatttatccatccatttattcattcagcaaatccttattgagccctgaccatgggccagtctctctgccaagccctggggacacagtgatgaaaaaactggccacagtttctgcttcctgcctcattccacttgcagtgagcggatattaaattggccataaacaccgagtacgatgaccttacaatccgcaaactgcacctttcatgtgtaaaaggattgctactactttacttgtcagctgtggatttccaaatgtggtggctccctcttatttttttttctttgaggagtgtaccaattttttatctttataaaccaggtaagggaaatgatgcccttgcccattttctacagacctaatcgatttttacctaatcagttttacagaaagggttacatggaagaagagataggggccaggaatgcaagagggacattggtgagtggggtaagaatccccgtagccctgggaaaggtgtctccacttccacatctggcttttctagggggcatctgtgctaactgacctgggattatgttggatggcatatgactgcaaattcaaagaaaccaatttataataagtttatagtaagttaaaggtttgttttactctcatgtgaagggaatctggaggaaggaaagccagggctggagtggctgcctttgatcatgggagcacactccttctgcccgatcattgggagcacactccttctgcctgatcgttgggagcacactcctgcctgatcatgggcgcacgttccttctgcctgatcgttgggagcacactccttctgcctgatcatgggagcacactccttctgcctgatcattgggagcacgctccttctgcctgatcgttgggagcacactctttctgcctgatcgttgggagcacaccccttctgcctgatcattgggagcacactccttctgcctgatcatgggcacacgctccttctgcccgatcatgggcacacgctccttctgcccgatcgttgggagcacactccttctgcccaatcattgggctcacgctccttctgcccgatcgctgggctcacgctccttctgcccgatcttgggcgcacgctccttctgcccgatcgttgggcgcacgctccttctgcccgatcgttgggcgcatgctccttctgcccgatcgttgggagcacgctcattctgcccgattgttgggagcacgctccttctgcccgatcgttgggcgcacgctccttctgcccgatcgttgggcgcacgcttcttctgcctgatcgttgggcgcacgctccttctgcctgatcgttgggcgcacgctccttctgcctgatcgttgggagcacgctccttctgcctgattgttggaagcacgctccttctgccttcagactccttgatttttagtgcagtttccatcactgaggctgcctcatgggctgagatggctgttgaagcactgaacctcacatccacaattcaggcaggaagcagaaggaagggcaatgggcaaaggggctgtgccttgcagccgatccagcctccctttgctgcagaggaggcagggaaatgcggtatttactgggaacattgctgcccctcctccaaattgagggtcttggctcgaaggacaaaagccagaaaggataggtggattagtgcttcttaaacttttgcgtgcatcagaatcacccagaaagatgttaaaactcactcttcaaggccccatccccagagattcggattctggggatttggaatctggggtggggtctgaagaatctgcattttttaacaaactcccaggtgacatagatggcatcaattctcaagccatattttgagtagcactgacactcttccaataggtggtactttgacttgtcagggaagttctattgctctgataacttaaaaccaacccaaccagaagctcacaaaaactagcagcctgtgaaaaatgatcaccattttcctagagctccgagacaactagtggtagtgcaacagtaacccaaaaatgtcaatgaaaatatttccttccccagaaactgcttggtttcactcaggtcctgtccttatgggcctgtgtctggttgcagggcttgaagtatttcggaagctcagcagaggttgaaccctttcccctgggggttggtgatctttgttttggccatttccacctggtgaagattttcatagacaaatatgcttgtggcatcctgtaattcattgtgccttatgatggacctctgattctataagcttccccctagctagggatgcacgggggtgatcaagacatgactagatgtgaacctgacctgcagacagtccacctgaacgtgcctggaaatgtctcccgaaaaggatgaaaagcctcctcctttagacaaggaagacagagtggagcaaatttctctacatagatctcattcgaaaacaaatttacagaatgcagaatggctactgtgtgtcttgtgctatgctaggtctctctctctctaagtggactctgaccctgtccaaaacattgtgcttttgcatgtagctgtgtcgcatttaggcccagctctaagaaccgtttggaaataaatcacatagagcctttgattgtgaggcaggcttaaagtacattttgtttgatttgcagaggcatggtgaggaatttatatgcatggctgttgtggcagcagcgagatttccaaaaagatgaatgatgaaatgaaacagactgaagctatctcacaaatgttaaatggagaaataaaagttgttatagtcattgctaattacagaatgagcaagagatttatttagcaggaccatactatgccccctggaaggttcagtttatgagctggagcacaaggatttactgtcatttcacctgaaaacacacatttagctgtccatttacctttaatcctacaggcttaaaatactttaaaatttcagagaccattaatatgtattcctttagaaagcaaaggtctttcagaagctgtcctctaccaaagttaatgtggtcaccacatttgatgattttgctaggtagggaggtttatttaatcacagctactgtcactcaggaggatgagccatttaaaaatggtggccctgtcctccacttcttacctaccatatataatctcagtaattcagatttctctaaatcagcattagtgatcatttcaatagggtatgaacaaaaggcctataaaaatagctttccaattcgccaccaaaaatgcaaaaatgacaagtaagtgaggtaacgcatgagctaaatagcttgatttagtcactctaaaatgtgggtgtgtatatatacatacatatatatacacacacacattatgttatacaccataaatatatagaagttttacttgtcaattaaaactataaataaagtggctttccagaaaaattagatattggactctatcacaaaggaattgcataaaaatacttacaaacataactataagcaattgatgagcaaattacaaatgactgttttttattaaaacattcctccaaaagaacggcaaagcaaatcccatagacacccaaaatactaaaagtgacaaaacaatacttctttaaaaatgtattttatgatctatttattgatattctaatggttttaagaaggataattttccaaaacctaaatgctacacattttacagtggcaatatcaaccttatcatgagctaaagatttgcaatcagaacattggtagagtgcattgctgagttataacaagtgtctcaggacgaggatatttggtaggtatccttaaatatatagatgcttaccagtaggtttaatagaagatttctgaaaggtagcgcaagtttttatttcattatttttatttttatttttttgagacagagtctcactctgtcatctaggctggagtgcagtggtgcaatcttggcttgctgcaatctccacctcccaggttcaagcgattctcccacctcagcctcccgagtagctgggattacaggcatgcgccaccatgcctggctaatttttgtatttttagtagagacggggtttcgccatgttggccaggctcgtctcgaactcctggcctcaagtgatctgcccgcctcagcctcccaaagtgctgggattacaaatgtgagctactatgcctggtcccaacttcttaaaattaaattttggggaagttcatggagatatttttgacatgtaaaagtagaaaacaaaccatccatagtgtgtgcatatatacacacaaggtttggtttaatatacttgctgtgcactagtcagttttgattcaggttacataagggataaaatatagaaagacattttaaagtttgaaatatgtgctaagtagttagagatttggcagttttgccacatttcaaatgggccaaacattaaaataacttatccatgaatttcaggtttcaaggaaggaggaatatctgactatttttttttgtgtgtgagatttggtctcagctttttggtccatctgaatcctggaagtccccaactctaccagaccaaaagggtgtctctattttttgttgttacttctctgttcttgatgtaatgagttaagtagatgaaagagattaaggtgcagggaagggctcttaaaagtttaatgtttcagctttccatagtcattcatacttgtgaatcttcttcctcttctacttcaaagtagccaaaacttggaaagttcaaattaatctttgggctccaaagagcaattctgaaggattaacaggtttcattctctccagtgggaggtggcctagacaggtgccggttttggggagaggtgagagtacccagatgtgggtgactatttcctgttcttccctgaaagtcaggccagtggtctcgaatcattcccacagcaactgctacaaaagtgactatcttaatcctttggctagatgggatacctcttctaccttttcagaggtgagctgttgagtagtaatgtccgctacaacaccacgctcccggaatggtggttcctaagagcaaagtcagttaatacaatttctccaggtatccagctatctccaggtgtgcggtcctgtgaagcactctaagaactgtaaaaaatatttcataggtatagaaggcatttgtaatactgttggttcaaatgtgctgacatgtagccagtggaggaagatgtttctttggaagcctgccatctttctgtaacgcaccttcaacctgagataattaagagtcattacgtttcccagtcccatgtcacattgaccagtcctgtggtcctatggctaagcggaggacacggccacaagctgtgagtcatgaaaaggagggtgcaggtgataggcaaagggacccattagccagtttacaatgactggcaactgaccagatagagcttaccgtatgtccatgtagagttgctcatattagtctgtaaataattctatgcatagtgaatgcagcttctgaattattaaactgatgctataaatgtgaactgacaaaaccca

SEQ ID NO: 6719 - DNA, 2099 bp, Homo sapiens
atatttattggtctgcaaatccggagaccttgcggcctcactggtcctccttccctctgagctatctccacacccagccttcgatcagaaggagatttagaagcagagctgcccgcagcgaatacttttaatgcccgggccgggaagaaagcgggttaggatctgatcccgctgagtagaggacccaggagcctcccgccccgcgtgctctgtagcgcgggggcgcgctgcgcgctgcgcctgggcggctggcgggggcggcgtgggcgcggtgatgcaggtgtgacacccgccggcgcctgcctccgcccggatcgcccagctccgcgttagccggagctgcacgcggggctgccggggcggacgctgctctgcctgcatccggaggcggccgccagcggatttgccacccagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccgg

SEQ ID NO: 6720 - DNA, 4077 bp, Homo sapiens
gctgctctgcctgcatccggaggcggccgccagcggatttgccacccaggtcctaagactctcagtccagagagggccctgccccacacccagaaggaaggaatgctgcccagagatgaccagaggaatctagacagagcataaccttcggtggcaggacaaatcaggccagcacgcagtctgccaagtcctgctcgctccctgtcaagaaaaacagctggatccatttctaatcaacacttcccaacgcaacacttctgagtctctgaaggagaccagagcttgaaactttccagacttccaacagacatcgagtgcaaaaggatatttaggttgtctttgcacaaatctggttgatttgagagataaagggggggggaaccagtgtgactttcacctaagaagtcacatgaacatatttcacatttgaactacataatgaatgatggttattgaaatagcccaaacctctaccacagagcgagggatatagctcaaggggcaaccaggcagtcgcagaaccaaggaatggatgactacaagtatcaggacaattatgggggctatgctcccagtgatggctattaccgcggcaatgagtccaacccagaagaagatgcacagagtgatgtcaccgaaggccatgatgaggaagacgagatctatgagggcgagtaccagggtatccctcacccagatgatgtcaaggccaagcaggccaagatggcgccctccagaatggacagccttcggggccagacagacctgatggctgagaggctggaagatgaggagcagttggcccaccagtacgagaccatcatggatgagtgtggccatggccgcttccagtggatcctctttttcgtcttgggtttggccctgatggccgatggggtggaagtgttcgtggtgagttttgccctgcccagtgcagagaaggacatgtgtctgtccagttccaaaaaaggaatgctagggatgatagtctacttgggaatgatggcgggcgccttcatcctgggaggcctggctgataagctgggaaggaagcgagtcctcagcatgtctctggccgtcaatgcctccttcgcctccctctcttccttcgtgcagggatatggagccttcctcttctgccgactcatctcaggcatcggtattgggggtgctctaccgattgtttttgcctatttttctgaattcttgtctcgggagaagcgaggagaacacctcagttggctgggcatcttctggatgactgggggcctgtacgcatctgccatggcctggagcatcatcccacactatggctggggcttcagcatggggaccaattaccacttccatagctggagagtgtttgtcatcgtctgtgctctgccctgcaccgtgtccatggtggccctgaagttcatgccagagagcccaaggtttctgctagagatgggcaaacatgatgaagcctggatgattctcaagcaagtccatgacaccaacatgagagctaaggggaccccagagaaagtgttcacggtttccaacatcaaaactcccaagcaaatggatgaattcattgagatccaaagttcaacaggaacctggtaccagcgctggctggtcagattcaagaccattttcaagcaggtctgggataatgccctgtactgtgtgatggggccctacagaatgaatacactgattctggccgtggtttggtttgccatggcattcagttactatggactgacagtttggtttcctgatatgatccgctattttcaagatgaagaatacaagtctaaaatgaaggtgttttttggtgagcatgtgtacggcgccacaatcaacttcacgatggaaaatcagatccaccaacatgggaaacttgtgaatgataagttcacaagaatgtactttaaacatgtactctttgaggacacattctttgacgagtgctattttgaagacgtaacatcaacagatacctacttcaaaaattgtaccattgaatcaaccatcttttacaacacagacctctacgagcacaagttcatcaactgtcggtttatcaactccaccttcctggagcagaaggagggctgccacatggacttggagcaagataatgacttcctgatttacctcgtcagcttcctgggcagcctgtctgtcttacccgggaacatcatttctgccctgctcatggatagaattggaaggctcaagatgattggtggctccatgctaatctctgcagtctgctgcttcttcctgttttttggcaacagtgagtctgcaatgatcggctggcagtgcctgttctgtgggacaagcattgcagcctggaatgctctggatgtgatcacagtggagctgtatcccaccaaccagagagcaacagccttcggcattctcaatggattatgcaaatttggcgccatcctgggaaacaccatctttgcttcttttgttgggataaccaaagtggtccccatccttctggctgctgcttctctggttgggggtggcctgattgcccttcgactgccagagactcgagaacaggtcctgatgtgaacaacctatgggaaaaggaaaggtcgagagaatcttgtccaggacactgaaatgcatccacacttcctgcctatcacggtccggaggacaccttggatagcacgggaggagaagttgactttgtgacccctagtttaggacccacttcagctgtcaatatgtttgtaactcaggtgactgatttgggggtgccctgagccacccttagaatcacagagctgcgtgtttaacttcaagtcttcccagtccaaggcagggagaggattctccagtgagtgcacacactatgcgaggagcaagcatttctctaagtcaagtgcaaggacttaacttgcgtttgaaaaggaattagagggtcagaaacacccaggttcctccagaaagctccttggagcccaacaacttaacaaatcaacttggctggaagttagagtcattatatgaagattgggcttgaagtatatatttttgcatttaaaagtatcacctatcatattttccactcgaaaattgacatagtagcattgaggatactctgatctagaaagccaagtatttgagcaacatctatagagatctacttttctcctatgtctcctaggctttccatgataattagggagagaagacatattgactctgactggacaccctgattcctccaaatatatataccactgtgtattaatctttctctcagtgttttataggagtactaacatttattgctctgtcaataatgaaaggctcgatgtaatatagctgtaatttactttccatatgaatacagtggctaggttcataaaagagaattgtgtgagtctgggattaccacatctaaaacattattctttaatgggataatacaattcattgagcagctaccacttaaaaaacttgcaggacagttagagcctgcatttctagttaagatggatcttgtaaatttaaaattggattaacattggagtgctggggtggctgcaataatttgggggctaactccatttggtttccaagatctcacttctgcattatctttatggctctttaaaccagccacctagccaatcaagggcaattcccatctcatccatcactcaggtctttgtaaagggtgcagccaagctctgcagacttttgcaggattgtctagcctgagtaccgggctacttcttaaatgccgtcactcctgctgagataaatgcgtctttaaaaatagtctctgtggcaggtcactgggggacaatgtacagcattctggccatccacttctttttcacttcatgttctaccccaagagactcccgatgtcggctgtggagggttaaagggatgaggctttcctttgtttagcaaatctgttcacagttcttgatgatgtattttatgatgcccagcttggaaatagttgctttccatagtctcaactgtattgtgtcatctcctgatgctgatttttgatcttttgttttattaaaaataattagtgaaaga

SEQ ID NO: 6721 - DNA, 3010 bp, Homo sapiens
gacggaggcagcccggggaagcgagccggagcggcgcccgcactgaggcggctgcagtgctgacaccactcagggcaagggtgtccgacggctggagcgttctgttttgaacccaaagtggatgatgctgtcagagctgaaccactgaaaggaggctgtgaaaatttcccatcttctcattggccatcagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccggcgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggcagcatagtgtacctcgggatgatggtgggggcgttcttctggggaggactggcagacaaagtgggaaggaaacagtctcttctgatttgcatgtctgtcaacggattctttgccttcctttcttcatttgtccaaggttatggcttctttctcttctgtcgcttactttctggattcgggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcaccgagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttgacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagacgcagagtcttgccatgttgccccggctgatcttgaactcctggcctcaagcaatcctcctgcctcagcctcccaaagttctgggattacagtctcgagccactgcacctggctttctttccatttttgaggattaaaattacttgaaattttccaaatatattatacaaggtcttgctaagaacttagtagatttctttattgttgtcttttttctctctcttttgccttgtagaaatatcccacaaagtgaagtaaccaagtcaacaagtgtgaacaattttatagctctccttaaatttactatacagctctcagaaacaacggagccagtttatagcaggagccattagtgggtgtggacctcttttctaagatctgcttctaaacttggctttatcacataaagagagaaaagcattacaaacaatttgaaggaattctttgtcttataaaaaaaattctgaaaacctccttgtattcccactaggaggtatagttaaccttgcaactccacaaacagaccactttacacacttgcccaggggcctttgtttttgcttgcccctcctctgaaatgctctctacaggtgattaagtggcttttccctttacttaggtgtctactcaggtaaaatcttaaccaagacgcctttacttaaaatgtccctctgccccaccctgaggcttttaacttgcatagccctcatcatcacctgacataatatgtacttctttgcttttatagatattatctgtgtccctccactaggatgtccatttcatgggaataaagactttgtctcttt

SEQ ID NO: 6722 - DNA, 11035 bp, Homo sapiens
gacttgccggagcaccgcgagtggcgcgcgggtcccgcctcccccgcgcgccgtgactccctgcgcaccgctggtactctcgccacgccgccgcccggcactgcagcaccagggggaggaggcaggcggaggagaggaggaggaccgcagcgtgcaagccgggagccactttcccgcccctcctctcgccgctgacacgctcagaggagtcaccactccgcgcgctgcaggcgagagtggcagacggaggcagcccggggaagcgagccggagcggcgcccgcactgaggcggctgcagtgctgacaccactcagggcaagggtgtccgacggctggagcgttctgttttgaacccaaagtggatgatgctgtcagagctgaaccactgaaaggaggctgtgaaaatttcccatcttctcattggccatcagttgagataagatggaagactcttacaaggataggacttcactgatgaagggtgccaaggacattgccagagaggtgaagaaacaaacagtaaagaaggtgaatcaagctgtggaccgagcccaggatgaatacacccagaggtcctacagtcggttccaagatgaagaagatgatgatgactactacccggctggagaaacctataatggtgaggccaacgatgacgaaggctcaagtgaagccactgaggggcatgatgaagatgatgagatctatgagggggagtatcagggcatccccagtatgaaccaagcgaaggacagcatcgtgtcagtggggcagcccaagggcgatgagtacaaggaccggcgggagctggaatcagaaaggagagctgacgaggaagagttagcccagcagtatgagctgataatccaagaatgcggtcatggtcgttttcagtgggcccttttcttcgtcctgggcatggctcttatggcagacggtgtagaggtgtttgtcgttggcttcgtgttacccagtgctgagacagacctctgcatcccaaattcaggatctggatggctaggcagcatagtgtacctcgggatgatggtgggggcgttcttctggggaggactggcagacaaagtgggaaggaaacagtctcttctgatttgcatgtctgtcaacggattctttgccttcctttcttcatttgtccaaggttatggcttctttctcttctgtcgcttactttctggattcgggattggaggagccatacccactgtgttctcgtactttgctgaagtcctggcccgggaaaagcggggcgaacacttgagctggctctgcatgttctggatgatcggtggcatctacgcctctgccatggcctgggccatcatcccgcactacgggtggagcttcagcatgggatcggcctaccagtttcacagttggcgtgtgtttgtcatcgtctgtgcactcccctgtgtctcctccgtggtggccctcacattcatgcctgaaagcccacgattcttgttggaggttggaaaacatgatgaagcttggatgattctgaagttaattcatgacaccaacatgagagcccggggtcagcctgagaaggtcttcacggtaaacaaaataaaaactcctaaacaaatagatgagctgattgaaattgagagtgacacaggaacatggtataggaggtgttttgttcggatccgcaccgagctgtacggaatttggttgacttttatgagatgtttcaactacccagtcagggataatacaataaagcttacaattgtttggttcaccctgtcctttgggtactatggattatccgtttggttccctgatgtcattaaacctctgcagtccgatgaatatgcattgctaaccagaaatgtggagagagataaatatgcaaatttcactattaactttacaatggaaaatcagattcatactggaatggaatacgacaatggcagattcataggggtcaagttcaaatctgtaactttcaaagactctgtttttaagtcctgcacctttgaggatgtaacttcagtgaacacctacttcaagaactgcacatttattgacactgtttttgacaacacagattttgagccatataaattcattgacagtgaatttaaaaactgctcgttttttcacaacaagacgggatgtcagattacctttgatgatgactatagtgcctactggatttattttgtcaactttctggggacattggcagtattgccagggaacattgtgtctgctctgctgatggacagaattgggcgcttaacaatgctaggtggctctatggtgctttcggggatcagctgtttcttcctttggttcggcaccagtgaatccatgatgataggcatgctgtgtctgtacaatggattgaccatctcagcctggaactctcttgacgtggtcactgtggaactgtaccccacagaccggagggcaacaggctttggcttcttaaatgcgctatgcaaggcagcagccgtcctgggaaacttaatatttggctctctggtcagcatcaccaaatcaatccccatcctgctggcttctactgtgctcgtgtgtggaggactcgttgggctgtgcctgcctgacacacgaacccaggttctgatgtaatgggaaaaaaagccatccttcctgcgtttcttcctcctgccctgggtcaattctccttcctgactcaaggcttcagagttttcctatatagaaaggtgatcaagtatcagaacataaacacgtgctgtgacttaaaatttagaagcatatcatcttgcccctttgtgattttgcacaggttgtttgtttgttttgttttgtttgaatgcattgttatctttccaaactgtgatgctactgcctcccgcaaatcagtggaagcatttctaaaatgccctaggcagccaggcttccctggggttctgctcattgaaagtttagaagctaagaagactgggctggtgtaagaaatagatcctgctcctaatttaacattaacaggaaatataagtcggcacattattgcatttgtgctgagaagagggattctttttttttttttttctaacagagtgatatttcctgtttacttagaaaaggacacccagtaattctcactgttatagcagagcctttcaaagaaaaccatgtggcaccaaacagggctgggtggggctctttggggcaagacaattaaggtgaccgctgacaagaaaaataaaagctctgcaattagcagcaaaaatctgagtgtgctgcataagcaagatttctgtcagaaagcccaattaaacctctgaaaagtgtgaggaaaaagaactgtaacagtatctgtgactgtggcatgtggttcagaatgtttgaaaatcagagatccgagagagagcttctgcctccatttaccactcccactccttcagctgcccttggtcttgccagacagcagattcagggaaagaaagctgcttcttaaaaactgtctgcctacctgattctgccacttacccacactgtctctagtctagagattgccagtggatagctaaattgtaaattgcaaattaggaagaaattcacacccagagccatttggaaatacaaaatggtacctctttccagtacctctttgctgtgggactggcccgccaggacccccaccccacctggcccgcagttgacattcagcttcccagctggcatcagcaaagagggtttgtccctctagcttccccagggctggcccactgctcaatgcgctcctggctccctgtaaaatcacagcccgcctgcactcctgagggcccctctcacagacagaccatctccctgtggttgtttgactgctcattttacctctggaatctgcctgggcttggaagaaagaggtcagccaggacattcccacgggcccgctgtcagctacatgaccttctcgcctctcaggctccccttcccccaggctcgtcctttttacacctcttctttgaaatctgaaccttccttgtagacttgcagccaatgaccagaagccaggaataaatcccatatttaaacaatattccttttttaactgcctcgatagaggtttattcttgttacttattataggcattttcaggcaagccatagcttggggcctccaggaagggaaagcttttgtttccactgatcattattttcagagatgtcctaactcccctgaggcccccctgcctccccctccccttcctaatgatccctcgcagagctcagactaagtgaaaagcttctttcattaacataagccattaatcgacttccccttgaagtaattcaggtctgcagaggggggaagactggtgttgggggcagtgggaagagggtggttccctgggggtctgtgatcagggctagaacatcaggaaaacccgaaccaaaaactgcaaaggtggcaggaagaagaaaaatcactgaaggctagacaagatgcatttgaaagataccaaccgcacagggaaagaaacaactttctctcacttctgcctcctatcattttattggagaacaaagacagcagtcaaacaacccaagaaagtaccctgtatgtttttcttcttccacatgtacccattttcccacctatctctccctgatttgtcttctttaaaaagacatttggggacctgagcaggtcttttagttgaatgcagcatgtgcagaaataactgcaaaagccaggagtgcatctccatcaacccatcaaaagaaaaatagaaatgtacatgggcatcgctgtctctagtcctctgtgatagttcactttgctaactagactacctttacttttcaaaatatctctaatgtctgctctggggtctaaatgcataaaacatctcccaagctgcagagcacagttattcagaattttatttgaacactgggttgggtcagcataggataaaccagcaaaaccttacttcatgagacctgccatccgtgtcccctgcagaaggaccgttcttggcctacttgttacctaatccaagcatccttggtggcctaagagggatcttttctcatctcctggacagtctgtggtcacaaaccttcttggtcaccacctctcccaccttttgtgcactcttccctgcctccttgagactgttcatcaccttgattttctaagagagctcaaatcatttccaaagcatgtggtgtggcctgtatagcttgctccagatttagctggagattaagaaacagccaggatattaaacagaaactctcagttgtatcagtgtagcaggccactggcacctaaacacgcaactggcatctcatttcgcctacagtagaaggaaaatgaaaatttgtacaaaaatgaaaacctaggaaatagtccacttgctcctatatttttaccaccttttctaactaaaatttccctgttgctctttggaatcaatccagaatgctcccaagtcccattattatcacagaatcttctcagtagggaaaaacaaacaactgcttcaaactgtgaattctgtatgtaccacattctatcccaggtattgggttttaaggcacccaactcacattcagtcctgctgcctgaatcatctcacaccagagtacagaccttggagacgcgatagatgggtcctagcctgaccttcaccactaagcggtacagggacccagatcttgctgtggagactgtaagtcgttgaacatctctagttctcactttccccgtgcacaaaataaaggattgggactagtctgctctccactctccagcattgtagaagacagtaatgaaaatagcttcatcttatctgccttcttatgctaaactcattttttttttttttaggtggagtttcactctgttgcccaggctggagtgcagtggtgggaactctgctcactgcaacctccgcctcccaggttcaagtgattctcccacctcagcctcccaagtagctgggaccacacgcatgcgccaccacgcccagctaatttttgtatcttttagtagaggtggggtttcaccgtgttggtcaggctggtctcgaactcctgacctcaagtgatcggcccacctcagcctcccaaaatgctgggattacaggcgtgagccactggcggcctcaactcatttttacaagcactaaataggtttagtttataaactgaaaaattaggaaataggcacgcataaaaagagtgtaggaagttgtttgggaagcccgcatggaataggccagaaagcacagtccccatgctgtctgccctgccagcatctcagcatcctgactagtatctctgttcactgcaggtttgacagttaccatcacccagccagaaaagggccccgccttgccagataaacgcgcttaggttagaagactataattgcaatattaccctacagctctcctgactgtttattccattattttcttgaaacatggccttaagtattatacataggcttcagaaacagtttttcagtgattttacctatattggcaaatagacaaatctcaccaaatcagagttcaggttttcaccaaaaactgcttagttgtctttcaagataccttaagagatcaaaggggaggtgggaaaagaaatgtagtgacagaagggagagtccaagataccactgataaggttccagcaaagagattaggacacagcagagactttctaaatgctggggtcatttccaaagcagtccaggggaatactttctgattccctctgccaatcaaaatagatagaatatgatattctccaattttttttctgtttgatgtcaaaatggcctttacctatttcttcagtaatatacctgatctgttcatgcactaaaggctctggagccaggaatgtctgaatttggccttcacctggtatcacagaaagacaactgggatattggtgttaaggggcatatcggctgtatgttaggttttctttaatcctcacatcgtgccaaacttagtctggttactaagcctaaaaacaccagtattgcaacaacttctgaaactctgaagtggactatatgtttctcacagtttttgtttatgctcagcaaagtatgtattttaagtaaagcttctcttgttatctgtaatgtagacaaaaaaaaaaaaaaacctgttagtatattctggatgtattgtgtgtcccttcattgtttcaggtatggcgtaacagttctccgtgtgatgttcttttgctctaaatgttgaccattcctcttgtcgcccgtctctcaccaaccagtcacagagccattgccagggctcccttcagtctttcttaaacaatatctaaatgcagtttagtaatcccaggattttgagttacaagaatacagtttatgggtctgtttcagctcttacttaaggctagcatggttgggcaggggaagagctgagccgagccttcactgatctcttgtcatttcatatgattatccagtaaatacttattgagcacctcccatgtgatacgtattgagacactgctgtgtgcaataattaagcctatggaggacttaaatgagggcaaggaaaacagaatgagagaagacactctcacactgacccccattacatgtgaaccctccgcgcccccccccataaatacaaagtgttatttttccacatttaaaacaaataatagccttcagcaggcagtgcaggaactattcagtcattgagataacctttgatgagaggagaaagctccttgattacctggtttttgttggagagactattaactagtacttggaaaatgagaaaaatgaaaccacacataagttgttcccttaaataatctcagcaggatattgcactaagatattattcaaggaaaagaatcaggagcagagatagccccatctctctagagcattttttttttttttttgggcgggggggcgggggacggagtctcgctctattacttaggccggagtgcagtggtgcaatctcggctcaatgcaacttccgcctcccaggttcaagcaattctcctgcctcagcctcccaggtagctgggattacaggtgcatgccactatgtccggctaattttttgtatttttagtagagacgaggtttcaccattttggccaggctggtctccaactcctaacttcaagtgatctacccaccttggcctcccaaagtgctgggattacaggcatgagccactacacctggcctaaagtcccgctttcttctgaggtgttcttttcatggtgtgaaaccagagacaggagctagggggtctgttccccagcgaatagtgttggggttttctcttcagagctaagtcagcaaagcctgcagctgctgccactcccctggtctgtgcctcccagggtgtttcctttctgattttgaagatttgtgggtgagtcaattatctttgcagacatcctaaagcagcttccctcctcgctaccctcagcagataagccatccagaaaacaggttctgacagccagtagcaggggtattttgggtttcagtttaaaactggtgcgtgttgttgcaagtgtcttgaagttgcaaaggatgtttggggttctagggcctgcaggggggcagagcagaaagagggtagttgtcagtgaccctctaccctcctctgagagccccattgccatttttgcccaccagttctcttcttacctcctcagggcagtgcccactcatttcctttatttcccttttgttttttttcttttcctcctctggtcgacaacctcttaattctagcagtgtacaaaagcaaggccaagctttcctggggcacttgggatgaaaggcccatccatgcctgttgtggaggcacagaggaggagaaggtgaagaacaggaatgggtgcagggggagtgtgaacgcaaggctgctggctttggcacagctccctgtgcagggctggatttccaattgcttttcagtgcctgtgccctgataggatgggcacagctggtatggaatcagagcagcccatctccagagcagaagtctgagagctcagcgtttgactcctgaaagaccaggatgttcctacctgggttcttgagattcattggctagtggaggtagatggtactctccatgtctgcagaagattccccacttggtgctgaaggctaggtgccttccagtcaggtctgaatgctgaaattgctgagattgtccactctctgcctactttattgcattcatgctccccttagatccaagagtgcccaggactaggagcagaaagcagttttcaaccctttgttcagactcagacgggtttcaactcaagcgggtaatctaccccagcagcaggggtgcaaagtccaaaacagctttgtggtgcctggggagtgactaggcagcctgctcacaggggctggagtcatctaaagctagtgatgagctggaatagctttgaaccggttcatccgaactgattgttaaactttcagaacttttgagagtcagttgagaaacatagctattactaaaaaattaaataagattagataaattatagctaaaagcaaaggcaacatatagtcaaagctcatcactttctacttattttactacattttaccattatctgtgcccatgaggtaatgtatgcctattatgtctgtatggtagaaatactgtatacaggtatactactacacacaccttcccaagtgacagtatttttgtagtttgagatcagctatagtggtggtatttataccatggaaagcaacaaagccatggaaagcaacaaagccatgcaaatcagactcctcctaacccctaagacagttgttaaacatttgccagcataccaccatctaaagccctaaagaatgcttggcctcccactgcatagacacaggccacatcacattgagtatcatggatttatgggtcagcattgcccctaagtccaaggaaggggaaagacttagcaagctcaacctcatgtgattcacaaagggtttctttctgcatttgtattgactcagaataggacccagtacagagaatccactgttatctatgggtgtcattccttcagaaagaatgtacagtaaaattggctatttcatgctatgcaaacaaaatgaaactagtttgaagttgcaaagtgtctcccctcttgcgcccacgtagtcatccaagaaggaaactcctttcttgccttgatattcaccaggcctacctagatagaacttgacaaattggcctaacttcatctccgctgctattgttatatatttgctttactgaatctatgtcctatgtcagtcagaagaaaaaagaaatgtcttttttaatatacactttcttagcatccatgcagttatgtatcctcatcctgatccaggaacatattgaacagatcatatgtcttttgttactatctagatacactaaataacatgatagaagagttttctctttcaggtgaacttccattttgaacatatgctaaacgtactatccactgtctattttaatgagatcttggcaatggtcctgtcggttttggtgtttggattgtttggctttgttttccttttttattcttcctgtttttaatgctgtgtaagatctcctgctatgaatgttccagttacccctattgtactgtatatacgtgtgctgcatgtgtaaattctgtttcaggttttggagttttcatcttaagtacagctggtcctgttgtgaactcatctttcctgtatgctcctctgtgtctgatttccaattgccaaaatgtttgaccaaatgtgttttgacaaatatcccgagacagccatgcgtatccttgtgaaagggcatgctccatgtgggatggctcgtgtacagcataaatctatcaaacttggaattgtgtatacatttatatgccagataactaacattcatgtaacagctgcaaagatatttagtgtatatcagattaataaaagagcattttttttttgctccattatattcaaataca

SEQ ID NO: 6723 - DNA, 2127 bp, Homo sapiens
gagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaa

SEQ ID NO: 6724 - DNA, 2151 bp, Homo sapiens
gcctccgagcccggccagcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaaga

SEQ ID NO: 6725 - DNA, 3624 bp, Homo sapiens
gcggccgcagcctctgagagcacgaacagcagcgcccccgcgtcccagccagccagccagccagactggactccggcccaccgacggccgctcgcgctccggccccgctcgcctgctctgccccggacctgcagctccccgctcccccgccgtgtccgccgcctcccggccagagagccaagccaccacgccgcgcccagcgctcgccgcgccagcatgtcctcgaccgagagcgccggccgcacggcggacaagtcgccgcgccagcaggtggaccgcctactcgtggggctgcgctggcggcggctggaggagccgctgggcttcatcaaagttctccagtggctctttgctattttcgccttcgggtcctgtggctcctacagcggggagacaggagcaatggttcgctgcaacaacgaagccaaggacgtgagctccatcatcgttgcatttggctatcccttcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtggacttctgtgtgactgtctccttcaccttcttctggctggtagctgcagctgcctggggcaagggcctgaccgatgtcaagggggccacacgaccatccagcttgacagcagccatgtcagtgtgccatggagaggaagcagtgtgcagtgccggggccacgccctctatgggcctggccaacatctccgtgctctttggctttatcaacttcttcctgtgggccgggaactgttggtttgtgttcaaggagaccccgtggcatggacagggccagggccaggaccaggaccaggaccaggaccagggccagggtcccagccaggagagtgcagctgagcagggagcagtggagaagcagtaagcagccccccacctggctattcccgaactggacagcacctcttcaaccacctccggcttccaggacctttctcttcctcctcctccaattcccctcccccatcattctggtctttgagctttgagacgatgggcaggcatcagctgttggaaacctgggcagccctctcagtggcttcctatcctccttcttgctggagccatgaatggcaggagctcagtgcttcttgtgcagtgcctggacccaggtatcttacttggggtcttacttgtacccttacagtctctgagaaccagcctctgctgcaggtgagggttgggggcaggaaaccagtgctctgagactggttcctagcagccacctttctgtcaacctgtccggcttcaacaatattagggggaagggaaatcagctagtagccttcccctctggtcccttgtgtggaggccccaatagtggtttggcgacccctcctcagtggctgtcatctagtccctgcgtctgatctccagtcatcccatgactcagtgtgccttccactgtcttctctggcctctgcctgcccacagaatccaccatgtgtgaaccagagaggtccaccagcctagaaaacagcccttcagagggtcctgatgaggccttcctggactcagctgggagcaagataaattgcaactgagttgcagcttcaagaaagtaaagccagtaagcttgctggcagaatcaatttcttctatcccctcaatcctcccacccaccaggctggggcactttccaccaacactctaaactctactttagaaacgccctatcttcctccctgtcctccttcttggtctcacacttgggactcaaaaatgtggagtcaggacctgcctcctaatccccttacttctctgtccatctcccttccccagcatcgtgcatctgaggcatttgagatcctttttgaagtctgtccaggccttccttttattcctgtggggccagacaggggcttaggaagggccaaaggaccatcatgaggctaagttgccccagagccccaggatggatgggcccattttttccttattccctgctcagttttttcccctgctccttctctagtccttctttcatatttctccttctcatcttgaaaacaggatgttccctcttcccttgctgtcccatttctcccctgtgtccttatttctcccagtctctatcccctctcaagtccagggcaggccgatgctattggtgcttcttcactttgggacccagttccatatttgtctttagtgtatatcctcttcctgatacctccttcagtccctctctgggccccaaggctgagaatcagtgttaactgggtaaggatcatttgcttcctacccagctcaatctgccctggccatagggcttcccagggaaggaagaagagggaagaatccgaccactttccaatccagtgccaattggcccactaagcatcctaaaggtgaatgtgccctgtgccaatctctcctcaggactgagtcaacccccttcaacctcctcacctctctaaacaccatccatagtaacatgtgcattactggggtacctaggagtcaggacttttgacttcaggccagtcatttcctcccgatggggaaagggtgagatttacatccccaaatgcttgagtccctcagtgaaagaattagtttttgtttgtttgtttaagattttggggaagagatttgaggaggaaagaaaggagatggggtgagagggtttttaagtctgaaactctctgtcatgagctgtccccatggttactcaaggacaaggggggacagttttgcctacagctccagagacacagagaacaaaggggtgaccttcatttttcttcaagccggcctctgtgggggtctgtgagcagcttctactggatctttgtttggattctgtgtctgtatttataatttatttgaaatgtgctgggtagtgttctcatttgggggctgaagttagcaactgggccttcagctagggaaagcagttgcgggcagggggtggggggagattatattcactcctgccaaggactcccagcccaggactctctttagagcaaggaagcctcgttctctttcttctcaagaggctctcttgttctccatcaggagagccttgatttaggctacggcctcactctctatggccaccctaagaggaaaggctacttcacctcattacctccagagggctgggcagggccaagtgcctcataggactcatgttctctccaaccagggctggcatcactgctttgcaaagtggggcctgaggtagaagaaggtgtctggtttctccagctgctgtaggaggctaatgggcagggtacttgccctttgtcccactagactctaacccagcaccagggtgcccacctaggacctttcctggacatgagtttccttcactatcatagtcatgagcctcctacttctgggattgcagatcaggggtggggggagaatgttgcatgttgttttctggtgcttgttattatatatttgaataaacagtgctgcaagtacttgccatgaagga

SEQ ID NO: 6726 - DNA, 1153 bp, Homo sapiens
aagttcgctgcgagtttgacagaagtttgaatccgagtcgggggctttctgctgccggcggggcaccgcggcggccgcagcctctgagagcacgaacagcagcgcccccgcgtcccagccagccagccagccagactggactccggcccaccgacggccgctcgcgctccggccccgctcgcctgctctgccccggacctgcagctccccgctcccccgccgtgtccgccgcctcccggccagagagccaagccaccacgccgcgcccagcgctcgccgcgccagcatgtcctcgaccgagagcgccggccgcacggcggacaagtcgccgcgccagcaggtggaccgcctactcgtggggctgcgctggcggcggctggaggagccgctgggcttcatcaaagttctccagtggctctttgctattttcgccttcgggtcctgtggctcctacagcggggagacaggagcaatggttcgctgcaacaacgaagccaaggacgtgagctccatcatcgttgcatttggctatcccttcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtgctctttggctttatcaacttcttcctgtgggccgggaactgttggtttgtgttcaaggagaccccgtggcatggacagggccagggccaggaccaggaccaggaccaggaccagggccagggtcccagccaggagagtgcagctgagcagggagcagtggagaagcagtaagcagccccccacctggctattcccgaactggacagcacctcttcaaccacctccggcttccaggacctttctcttcctcctcctccaattcccctcccccatcattctggtctttgagctttgagacgatgggcaggcatcagctgttggaaacctgggcagccctctcagtggcttcctatcctccttcttgctggagccatgaatggcaggagctcagtgcttcttgtgcagtgcctg

SEQ ID NO: 6727 - DNA, 2607 bp, Homo sapiens
aaagcagtcctgcacttccagttgtgagccaagagccaagtgtgggagctcaccatggtggcagccacctccccaccaagcaggcagcgttcaccagaggggagtatcaggttcctgtactcagctgtgggttgtcactgtctaataatatgaccgttttgccatctctctgcaaatgaggctgaagctgctatctgattggtataacatctcactttccctctgcattgattttcttcttctcctcctttgcttcataaaaagagggacaagtggctggtgctgtggacagagaagctttatttttagtatgagacaacctctattttctttcaggagagggaagttggattatcaattcttttgtaaatgtgtatggtgatatttgctccgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 6728 - DNA, 2383 bp, Homo sapiens
ataaaaagagggacaagtggctggtgctgtggacagagaagctttatttttagtatgagacaacctctattttctttcaggagagggaagttggattatcaattcttttgtaaatgtgtatggtgatatttgctccgcataatgaagaatgcaagagtcatttccatttactttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcatac

SEQ ID NO: 6729 - DNA, 2709 bp, Homo sapiens
aagtttccccggagccagagggcaccgggcgcacggctgagcctgcaccaatgtctgtgggccctgcctcgcccacctcctcgccctcccctctggagcgcggctggccaatgacagccttcccctggctccatgggtttccccctcccctgttgtatctaccctgccccagctcttccctgcccacccctcgctgactcgcttcgcttccccgacgcgctgggttcccggagcgcagagcccagcgttagcgggtgggctccccgaggccccctgccctcgccgggctgctccagggtgtcgctcctctggctgctcccgaaggggcttctggccctgaggacggtggtgccaagcgaacttcatttttaaaaagaactggtggatgagaagagcgagcgagggcgagctatggaccctgtgagtcagctggcctctgcgggcaccttccgggtgctgaaggagccccttgccttcctgcgagccctggaattgctttttgcaatctttgcatttgcaacatgcggtggctattctggaggcctgcggctgagtgtggactgcgtcaacaagacagaaagtaacctcagcatcgacatagcgtttgcctacccattcaggttgcaccaggtgacgtttgaggtgcccacctgcgagggaaaggaacggcagaagctggcattgattggtgactcctcgtcttcagcagagttcttcgtcactgttgctgtcttcgccttcctctactctttggctgccactgtcgtttacattttcttccagaacaaataccgggaaaacaaccggggcccactcattgacttcattgtcactgtagtcttttcgttcttgtggttggtgggttcatcagcttgggcaaaaggactgtctgacgtcaaagttgcaacggatcccaaggaagtattgctactaatgtcagcttgcaaacagccatccaacaaatgcatggctatccacagccctgttatgtcaagcttaaacacttctgtggtctttggattcttgaactttattctctgggctggaaacatatggtttgttttcaaggagaccggctggcattcttcgggacagagatatctttcagatccaatggagaagcactccagcagctataatcaaggtggttacaaccaagacagctatggatcaagcagtgggtacagtcagcaggcgagtttggggccaacctcagatgagtttggccaacagcctactggccccacttcctttaccaatcagatttaacagagtagcatttgcattcttctgcagtcgcctcaccatcttccatttcagtggcagaagaattttttaagggtttcaatcaattattaatgcagagagtattgaatgtaaatcagagctctctagtcttcattaaggcagcaagtcctgggttgtgaaaaatgatacttagagatgaggcgacatgaggagatatattattcatcatagatggctaattggagagtaccttgttatatatacagatactttcatggtcattttgtatgtatgttaaagtagtagaagtattttgtagcttaaagtctctagtatgtaatatgcataaagtaaatcaaatagcgttgagttttcttatgcattttgatgtgaaagatgttataataatttctagaagacaatttggtgtatcacaacatgcatgtcttatttttttttagttttaagtcctataggactatgagtctctaagttatttgtttcagaaaattattctttttttatgtgataaatcatatgatttaagtgcatgaataagcattttcccacacaatgaacatttgaactgtgtttatgaaaattttctggtttgcaccatgaatttgtcaaatggatatttataggaatatattcactactttgtatactttgcaaatttgtctctctggctttacccaagttctgaatgcattgtaattaaaatttaagtttttcttttcccccattagtaaacatttagtgctacatatgataactgcccaatatttattctatttacttagctaaatatttgcattcttgtaaccttctatggtgttttgtggctcttatcttgtggaccataaataacacggcccaataactctttgtgtttatggagtgttgttttcttagaataatggagatgcagatatagataccatagtcaaggtaccgccttgctgaagtatttatttataaagaatattctgtagaacctctactaccagctatatttttaaatcctgtttatttgtaaagctaatatgctcctcaatgtaattattaaaaattctcaagtcacagctaaacttactaattctgattttagtgtagcccctaaattaaaaatggcttccatatgccactctgtaccccaaagagagttctcatgaaatattctccagaatgtattcattatcaagaaaatgtcaatcgtcacttcctcgttttaactcagctgaaacaccaggacccaatagagagggcaagctgagcatctgtatttccagataaaagttgttattgatgtataaactcgttgcgtgattagtgatgttggaagcattttagcacaaaacagccttgtgtcttagatgatatctgtaaccagtttctgaatcccgttggataaaactgtattgtgatatctatttgatgttaataaagttattgcataca

SEQ ID NO: 6730 - DNA, 4493 bp, Homo sapiens
ccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactacctacaaaccttctttcaacaagtgcttcctaattttgagatctgaaagtatgttccagcatcttttgagtcatacaaccaaagtatgaggagatcacaagtcttttaaaaagttgtgctaaaggagaaatacttcagaaatatgttacatttgttttggatcacagtattatttatttctcaagaagagatttgttcatcatagtagtattagcccggtgcaggaagaactcaagtaaaagacaagaaaaaacaaaaaacagtgttgattgtgggatattaaggaaggctagaatttaagcaactgagtaaagtaaaatgatgtactgagaactaaagttgtattccttggtacttccgagagaaaacagacttggatttttattggatgattcctcctaggaagtaagatgagggcgttcaagaataataacaatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatgctttctcctctccaccacaaggggcctctcctgtgcctgagagttctctcactgctgacctcttatctgatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaa

SEQ ID NO: 6731 - DNA, 4136 bp, Homo sapiens
gtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaa

SEQ ID NO: 6732 - DNA, 4434 bp, Homo sapiens
agctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaa

SEQ ID NO: 6733 - DNA, 546 bp, Homo sapiens
atccgatgcattccccgaagcctgcgggctgctaggaggaaagtctgctgaggtgggagatgggcaccgaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaag

SEQ ID NO: 6734 - DNA, 4449 bp, Homo sapiens
agctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaa

SEQ ID NO: 6735 - DNA, 4726 bp, Homo sapiens
gtggtgcgcgagcccagtgcgtgccgggtgcggcgccagcagcggaggggcggcccggcgcccagcggagagccgctggctgggtgggtgtcggcctccccgcctccttcttctccccgccggcttgccggggatgcttgcgcgaggcgccccctcgcctttaagctcccggccccggggggcggtgtgtgtgagtagctgggagggggccgcgaggcgctccgccgagggctcgtccgggtttgtccgccgccgtcacctgactcgtcggaggagccacagctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaataaaatatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgc

SEQ ID NO: 6736 - DNA, 3805 bp, Homo sapiens
gtggtgcgcgagcccagtgcgtgccgggtgcggcgccagcagcggaggggcggcccggcgcccagcggagagccgctggctgggtgggtgtcggcctccccgcctccttcttctccccgccggcttgccggggatgcttgcgcgaggcgccccctcgcctttaagctcccggccccggggggcggtgtgtgtgagtagctgggagggggccgcgaggcgctccgccgagggctcgtccgggtttgtccgccgccgtcacctgactcgtcggaggagccacagctgaggtgggggcggggatggggacgcagctcggagcgctagagagacgcggcggcgctggcagaagaggcggcggcgggcgggtactggcttctggggccaggggccaggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcgggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggaggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgc

SEQ ID NO: 6737 - DNA, 4452 bp, Homo sapiens
gtggtgcgcgagcccagtgcgtgccgggtgcggcgccagcagcggaggggcggcccggcgcccagcggagagccgctggctgggtgggtgtcggcctccccgcctccttcttctccccgccggcttgccggggatgcttgcgcgaggcgccccctcgcctttaagctcccggccccggggggcggtgtgtgtgagtagctgggagggggccgcgaggcgctccgccgagggctcgtccgggtttgtccgccgccgtcacctgactcgtcggaggagccacagctgagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaa

SEQ ID NO: 6738 - DNA, 1460 bp, Homo sapiens
agaggataatcccagggtgcggagaagggcagcggccgagtgacagctccgcggagcgctccagggcgggcgggggactgggcttcgctgtcagcccggctcctctccaaagccaggaaggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaagtacgcatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggaggtagtgcagaggctgcacctgagctggacctctttgcaatgaagccacctgagaccagtgttcctgtagttacccctacagctagcacagcccctccagttcccgcaactgctccttctcctgctcct

SEQ ID NO: 6739 - DNA, 592 bp, Homo sapiens
atgctgcgactggagcccacgctggggttccgtgacggccctactcacggccaagactccctggaccgcatcgcaggagcggggcttggcgcgttgctggctccgagagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggg

SEQ ID NO: 6740 - DNA, 842 bp, Homo sapiens
caggggcggtgggcgccgggaccgcggagctgaggagcggggcccggccagggctggagactttgcgcccgggggcaccggggctacgcgcggtcgcacacatccaccggcgcggcttccctcggcggcccgggctccgctcatcctgcggcgggcggcgccgctcaggggcggggtgagtacccgcggccgtactcggccccctccccgcgccagggtctcgcggggatccgcagaggataatcccagggtgcggagaagggcagcggccgagtgacagctccgcggagcgctccagggcgggcgggggactgggcttcgctgtcagcccggctcctctccaaagccaggaaggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccg

SEQ ID NO: 6741 - DNA, 525 bp, Homo sapiens
ggggactgggcttcgctgtcagcccggctcctctccaaagccaggaagggtgaggcgccccaagactccggcgcctccgcagagctcccgggcggcccctgcggcagggatttggaaccggggggaaggggcccgggcgatgggcctcggcgaggctttggagccggcggcgaggaaggaaggggaggcgagggcataacatggcgcaacgctaggataatctccttcgcgactgagggaggacgagccctttgctgcagcagcgcgaggaggaggagggaggcagccagggcttggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgg

SEQ ID NO: 6742 - DNA, 2168 bp, Homo sapiens
agtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagaggctcccagcagtcttatggagacgcttgaacagcatctaaatacattagaaggaaagaaacctggaaacaaatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggaggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgat

SEQ ID NO: 6743 - DNA, 4521 bp, Homo sapiens
gagacaagcggaggagcctgaggagctgaagacgcacaggtgacggtcgcggatggccggcaggatctgacatttaaaatcgccctgctcatctgggcctcggagcctttgacaggcgggcgtgtcagcgacagtgtggggaaggggctgggctccgccaggcagcgcgcgacgacgcccttgccttggccttcacagagtagaacccgagaagcccactcgcccgtcttggccaacgcccccaacgcccagggctccccccgcagtcggcgggcaggtgtgcgtggtgcgcgagcccagtgcgtgccgggtgcggcgccagcagcggaggggcggcccggcgcccagcggagagccgctggctggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaatgcaaacataa

SEQ ID NO: 6744 - DNA, 4263 bp, Homo sapiens
gactcgtcggaggagccacagctgaggtgggggcggggatggggacgcagctcggagcgctagagagacgcggcggcgctggcagaagaggcggcggcgggcggaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatggttatgatatgtctaccttcataaggcgctatagtagatatttgaatgaaaaggctttttcttacagacagatggcctttgattttgccagggtgaagaaaggggccgatggtgtaatgaggacaatggctcccgaaaagctgctaaagagtatgccaatactacagggacaaattgatgcactgcttgaatttgatgtgcatccaaatgaactaacaaatggtgtcataaatgcagcatttatgcttcttttcaaagatcttatcaaactttttgcttgctacaatgatggtgttattaacttactcgaaaagttttttgaaatgaagaaaggacaatgtaaagatgctctagaaatttacaaacgatttctaactagaatgacacgagtgtctgaatttctcaaggttgcagagcaagttggtattgataaaggtgacattcctgacctcacacaggctcccagcagtcttatggagacgcttgaacagcatctaaatacattagaaggaaagaaacctggaaacaatgaaggatctggtgctccctctccattaagtaagtcttctccagccacaactgttacgtctcctaattctacaccagctaaaactattgacacatccccaccggttgatttatttgcaactgcatctgcggctgtcccagtcagcacttctaaaccatctagtgatctcctggacctccagccagacttttcctctggaggggcagcagcagccgcagcaccagcaccaccaccacctgctggaggagccactgcatggggagaccttttgggagaggattctttggctgcactttcctctgttccctctgaagcacagatttcagatccatttgcaccagaacctacccctcctactacaactgctgaaattgcaactgcctcagcttctgcctccactactacaactgttactgctgtcactgctgaagtggatctctttggagatgcctttgcagcttctcctggggaggcccctgcagcatccgaaggggccgccgcaccagctaccccaacccctgtagcagcagcacttgatgcatgttcaggaaatgacccctttgccccgtctgaaggtagtgcagaggctgcacctgagctggacctctttgcaatgaagccacctgagaccagtgttcctgtagttacccctacagctagcacagcccctccagttcccgcaactgctccttctcctgctcctgccgttgcagctgctgctgctgccactactgctgccaccgccgctgccaccaccactaccaccacctccgctgccaccgccaccactgctcctcctgctctagatatctttggtgatttatttgagtccactcctgaagttgctgcagcgcctaagccagatgctgctcctagcatagacctgtttagtacagatgctttctcctctccaccacaaggggcctctcctgtgcctgagagttctctcactgctgacctcttatctgtggatgcatttgcagcaccatctcctgcaaccactgcctcgccagcaaaggtggattcttcaggtgtcatagacctttttggggatgcatttggaagtagtgcttctgaaccccaacctgcatctcaggctgcttctagttcatcagcatcggcagacctactagctggatttgggggttctttcatggcgccttccccatctccagtgactccagctcagaataacctgctacagcccaattttgaggcagcttttgggacaacgccttcaacttccagcagcagctcctttgatccatcagtgtttgatggtctaggtgatcttttgatgccaaccatggcaccagctgggcagcctgcacctgtctcaatggtaccacccagtcctgcaatggcagccagcaaagcccttggaagtgatcttgattcatctcttgccagcttagtaggcaatcttggaatttctggtaccacaacaaaaaagggagatcttcagtggaatgctggagagaaaaagttgactggtggagccaactggcagcctaaagtagctccagcaacctggtcagcaggcgttccaccaagtgcacctttgcaaggagctgtacctccaaccagttcagttcctcctgttgccggggccccatcggttggacaacctggagcaggatttggaatgcctcctgctgggacaggcatgcccatgatgcctcagcagccggtcatgtttgcacagcccatgatgaggcccccctttggagctgccgctgtacctggcacgcagctttctccaagccctacacctgccagtcagagtcccaagaaacctccagcaaaggacccattagcggatcttaacatcaaggatttcttgtaaacaatttaagctgcaatatttgtgactgaataggaaaataaatgagtttggagacttcaaataagattgatgctgagtttcaaagggagccaccagtaccaaacccaatacttactcataacttctcttccaaaatgtgtaacacagccgtgaaagtgaacattaggaatatgtactaccttagctgttatccctactcttgaaattgtagtgtatttggattatttgtgtattgtacgatgtaaacaatgaatggatgttactgatgccgttagtgcttttttggacttcacctgaggacagatgatgcagctgttgtgtggcgagctatttggaaagacgtctgtgtttttgaaggtttcaatgtacatataacttttgaacaaaccccaaactcttcccataaattatcttttcttctgtatctctgttacaagcgtagtgtgataataccagataataaggaaaacactcataaatatacaaaactttttcagtgtggagtacatttttccaatcacaggaacttcaactgttgtgagaaatgtttatttttgtggcactgtatatgttaagaaattttattttaaaaaatataaaggttaacgtccataataaatacttctctttgaagctaccttatcaagaacgaaaaatcgtatgggaagaatcccctatttatcactgctatattaaaatatatatattttaattatatttgacaggttttgcatctaaattgacctatttattcattcttgattaaatgcactgaaaagtaaagggtctgtttgtgtcatgttcatgaaaatgcggttagagaggtgctattcaagtgattctgaaggcaccccaaggtatatctgtaatttaaagattactgcaaatatctttactttactgtgggtttttagtacatctgttaatttagtgtttctttgtgtgttttgtagactagtgttcttccatccttcaactgagctcaaagtaggttttgttgtaacattgtgattaggatttaaactaattcagagaattgtatcttttactgtacatactgtattctttaagttttaatttgttgtcatactgtctgtgctgatggcttggcttaagattttgatgcataaatgaggtcactgttgatcagtgttgctagtagcttggcagctcttcataaaagcatattgggttggaaaggtgtttgcctatttttcaaattatttaatagatgtatggtaccatttaaaagtggttgtatctgaatttactgtggggataacatacactgtaatggggaaaaattacctaaaaccaatttcaaaatggctttctttgtatttcagtttaaaaacccagtgcatgtacgccctctgagatgcaataaacaccttgaacaaagaaa

SEQ ID NO: 6745 - DNA, 736 bp, Homo sapiens
gggcgggggactgggcttcgctgtcagcccggctcctctccaaagccaggaagggtgaggcgccccaagactccggcgcctccgcagagctcccgggcggcccctgcggcagggatttggaaccggggggaaggggcccgggcgatgggcctcggcgaggctttggagccggcggcgaggaaggaaggggaggcgagggcataacatggcgcaacgctaggataatctccttcgcgactgagggaggacgagccctttgctgcagcagcgcgaggaggaggagggaggcagccagggcttgggtatccgatgcattccccgaagcctgcgggctgctaggaggaaagtctgctgagaagaggaggcggtagacgcgaccacagaagatgtcgggccaaacgctcacggatcggatcgccgccgctcagtacagcgttacaggctctgctgtagcaagagcggtctgcaaagccactactcatgaagtaatgggccccaagaaaaagcacctggactatttgatccaggctaccaacgagaccaatgttaatattcctcagatggccgacactctctttgagcgggcaacaaacagtagctgggtggttgtgtttaaggctttagtgacaacacatcatctcatggtgcatggaaatgagagatttattcaatatttggcttctagaaatacactattcaatctcagcaattttttggacaaaagtggatcccatgg

SEQ ID NO: 6746 - DNA, 6443 bp, Homo sapiens
cgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcgggcagggaaaaggggtcgaggccggtcctgacctgttacaatgaagactgacttgctatgtgggattacaccagaagcttgcagtggagtaatggtaaggaaatcaagcaaccttaaatatgtcggctgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttccatttcttatgcaggtcatgataacttgtagagtagagtacaatcatttgtgctatgtttttaattttctaaagcaccttgatgacagtgagtgtccagtggtgaagcatcctctattgaaccaccctcaaaaatttttttgccaagtcctaagttgatagcttaaagtaaaaagtgaaaattatagtttcattaggacttggtgtaaagaaatcccctccccccttccccaaagggatactgcagttatatcacatacccaataggcaccacgatgaagatcagagcttatacttaattaaggttttatacacaccagttccccagtaaatgcaaatttaacaagaaaatcagacatgtcatatgttcaaaatgctcatggcaaacaatcattttgcattcctgcaaataaaattgttttatactgtaagctggaggcgagtgtaacttatttttgtaataaagtttttattttttttatgtgtcattaatataaatgtgtgttagtgtagaaatcttctggtttaaaaacttagaattgcacacatttcagtatgtttatttgtacttacataattttagaatagtggttgccaatagcctgtatgtttcacattaattggttttttgttatctaaataaatcattttagtatgttgtatgtcagttactgggatagctgggacatagagtgtaatttaaaatttgtcaataagtattcattggaatatatgtaaatgtgccttgccggttattgaaacttatctacaaaatgagtatggggtgacaaaaattagttcctggtgcttaatgaaactttctgccactgattttatatattaccccgtgcttttttaaagtacatctctctcaaaacttagtgtaagtttgagggctacacaaaacatttacatttcattctaacataatgaatataataggttgtggaaagtgggtaaactaaatgtagccttcagtaaaattgaatctcagtgtaatccttggtgctggcatttctcagttccgaggagttaaatgatcccatctaagaggtcattgccatgcctattggcactttactgtcatagcatttttaagggacactgtcaaggtgtttaagttctcagaattacttgttgggattttaggacaggtttgtttacttaaagtaagaactgcattgtcaaagttgaaagaggaacacttttgtgagttcacaaatgtgttcttaagaaaacattaaaatatggagctctgggttttcaagactatttggcattcttaatttggggacttgggagggaaactgataaaaagaaattgaagaattgatggttatacttaaagaagggtaatgtaaacagtggtgatgaaatatatacacatcaagtgaaattacttgacagtgttcatttgaatgactttgaattcaagccattataattacttttaaaattaaatatcatttgcactgttctgataatgggtgcagtttttgagcaatataatcagagctaaatatgcatgtagtgattagtgatgtgaacaattaacgttctgagaagaaatactaactgtggtattttcaaacttaaatttctgtagtaaaatcagtatcaaagtcttatcagatcaaggaaaaacaggcaatgcatataaacatacttttgaatgttgtgtggcctataaagcaataatgcaatttatatggaatgtcatgggatatgagaaatggaaatgcaaaaataactaatcctttagtaaaaatgtcaacatgttaaagggggaatgttaactaatgtaggttattgctatttgtgatttgtttatgggttcttggctttgacagcttcaaagaatggacagtgataagttaaaagaaattttgtatattgtcaaggaaagggtcttaaatccgagtcaagtcccttccttggggtaaaaaatgtattcttaaagcattctgatgttaaaaagaaaacttaagttatctaaccaaaacagacgcaagattttgtttctgcagactacttggcaatcaaaagtgatcataaatttaggttatcagttttcagaaagttgctttgtgagaaaattttgttagatatattctcccaagcatgctttttgtggaaggttttcagccattgccactgaatcagatgttaaaaatgaagggaaaattgagtgtgcacacacacaactgttgtacactcatgattgcagtttttagcttaagaaacttttctaccagttactgtgaatctgacttaaaatgtaaagtttcctcatgataaaataggaacaacatagaaatggattgatggggtgatctgagttattgtatataaaagtttttaaagaatagaatgaacatcaagctagataggcaaaaattgacacattcagaacagcttttttgactgcgaagccaaaagttgtcagaaacagcaaaagatcccttattattacagagtattttacgtagtctctattttaaggagagaaattaaatagaagggcttcatgcatttaggggagggtgctaaaacttctcaagttcgtcaaacttacaggaatacccaccatgatcattttctctctaattatgtataccacaaaattttcatctggccataggaattcactggtgggtgtaaaattaatgactaaagaaattaagtgacaaatacataaaagaaacagacttgtggggatattgttttaaggtgtattaattactcagtgatgataccactcaatagggcatgccactacttttcttaagatgctaattatgaagcagtgctcacaggcattttttaactagcaaattagtagatggacttttggggtctgtcactttttaaaagtatttaagacttaaattctattagcaccacagtctgccttcagtaatacacctaaaatatttttcaggaccagaagcattcagtttgaaaatttgcagatgcaaaccagtattattactaacgctctgggtcaaagattaggtttttaatattaacagtagtctggtaaatatttagaagtctggcattgagaaacaaaagcttgtacctgactagtatttttatttaaaaaaattagttctgttagcttatttaaattgtgttttatttatccgtagaatttatatttatttcattcctttcatctcactgaaaactgtctgcaggccctttgatttggattagatgtgtgaagtactgtcttttgccaaaaacctcaaattacctgttcttttcaacgtagtgggtttgtgcttgtttggagatcagttcaaaaactatctgtactatctgtactgcctctgatgttaagattttatgtatagcataaggaagctagctctgactatattttcctaagaataaagacctatttttgtagc

SEQ ID NO: 6747 - DNA, 3023 bp, Homo sapiens
ctgggggaccgggccgagagtgcgagcgagcgagggagggagtgagggagcgtgcgagccagaaggggaaaggcggccactcgtgcctgagcgaccgcagaggggagtgggagcagtggggtaaaggagcggggggcgggaataagaaaggccgagagaaggcggacagaggctagtggtggtggtggtggtagggggagaaggaggagctggaggagggcaggggctgagggagtgagtgaagcggacgcgcgagggaggggagggaagggaagggaagggaagggggggtcacgcgggggcgcgcgcgcgcaccgggagcgcgctcggaggcgagtggaactggatcgggtttgctgccagcggcgtgagcttcggccgccattttacaacagctccactcgcgccggacacagggagcagcgagcacgcgtttcccgcaacccgataccatcggacaggatttctccgcctcagcccaacggggagatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagctggacctatatgggatcttcgtctaatgatggatccactcactggtctcaatagaggttatgcgtttgtcactttttgtacaaaagaagcagctcaggaggctgttaaactgtataataatcatgaaattcgttctggaaaacatattggtgtctgcatctcagttgccaacaataggctttttgtgggctctattcctaagagtaaaaccaaggaacagattcttgaagaatttagcaaagtaacagagggtcttacagacgtcattttataccaccaaccggatgacaagaaaaaaaacagaggcttttgctttcttgaatatgaagatcacaaaacagctgcccaggcaaggcgtaggttaatgagtggtaaagtcaaggtctgggggaatgttggaactgttgaatgggctgatcctatagaagatcctgatcctgaggttatggcaaaggtaaaagtgctgtttgtacgcaaccttgccaatactgtaacagaagagattttagaaaaggcatttagtcagtttgggaaactggaacgagtgaagaagttaaaagattatgcgttcattcattttgatgagcgagatggtgctgtcaaggctatggaagaaatgaatggcaaagacttggagggagaaaatattgaaattgtttttgccaagccaccagatcagaaaaggaaagaaagaaaagctcagaggcaagcagcaaaaaatcaaatgtatgacgattactactattatggtccacctcatatgccccctccaacaagaggtcgagggcgtggaggtagaggtggttatggatatcctccagattattatggatatgaagattattatgattattatggttatgattaccataactatcgtggtggatatgaagatccatactatggttatgaagattttcaagttggagctagaggaaggggtggtagaggagcaaggggtgctgctccatccagaggtcgtggggctgctcctccccgcggtagagccggttattcacagagaggaggtcctggatcagcaagaggcgttcgaggtgcgagaggaggtgcccaacaacaaagaggccgcggggtacgtggtgcgaggggtggccgcggtggaaatgtaggaggaaagcgcaaagctgatgggtacaaccagccagattccaagcggcgccagaccaataatcagaactggggctcccaacccattgctcagcaaccgctccaaggtggtgatcattctggtaactatggttacaaatctgaaaaccaggagttttatcaggatacttttgggcaacagtggaagtagaaacagtagggcctctgtaaaattggagactgataggttgatcagaaactcaccctaaatctgaacgggtgccgctataatttgtgacatctggcaagatttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtctttaatatcttgtatcagaataactttgtatgttaccaacttaaattgctagaataaggtaaattgatacacaactgctatttttaatttagaactttgacctaatttgggttttcaaaaccattttggctacttgtattctttatgctgttgtttatttcaataaaaaattcacacctaaatgtatacttactaaaattgtgtttacaattcgtttttcacaaaatttcctgcaaatttggttcaaattgtatagcatgtcaaggccaattaaagggttttgtgccttgttaa

SEQ ID NO: 6748 - DNA, 610 bp, Homo sapiens
gcggccgcggagccgggggcgggggccgggcgcgcacagaccgatctctggaaacatggctacagaacatgttaatggaaatggtactgaagagcccatggatactacttctgcagttatccattcagaaaattttcagacattgcttgatgctggtttaccacagaaagttgctgaaaaactagatgaaatttacgttgcagggctagttgcacatagtgatttagatgaaagagctattgaagctttaaaagaattcaatgaagacggtgcattggcagttcttcaacagtttaaagacagtgatctctctcatgttcagaacaaaagtgcctttttatgtggagtcatgaagacttacaggcagagagaaaaacaagggaccaaagtagcagattctagtaaaggaccagatgaggcaaaaattaaggcactcttggaaagaacaggctacacacttgatgtgaccactggacagaggaagtatggaggaccacctccagattccgtttattcaggtcagcagccttctgttggcactgagatatttgtgggaaagatcccaagagatctatttgaggatgaacttgttccattatttgagaaagct

SEQ ID NO: 6749 - DNA, 7614 bp, Homo sapiens
atagagagagggagagactcgagagcgagcgagcgcgggagcgagggccgcagcggcagggccggcggggaagtgggaagagggacctggacttcgggaccccagctgtccccgcccccgcccccgcccccgccctctccaccagctcaggctgaacgcgcccggaacgtcccaggctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcctgacagggaaggcatcacagtggccaatgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcccttgccattttttcaccacagaaaactcatggcttctccagaagcctgagtatctctctttcccagcacaaatggcagcatctctatcctgccccatctgggccacttcagcttcctgtagacacccaagacagatggacagtgttggagggaatcaggctttgaggatccagtgtgaagaagttgcagagtgtctttttattttattttaaaaagggggaaggggcttttggttttgctttgttttttggatgaaggagtgagggaaatgagggaatacccccaccagaaacagactggaaagcctgcctgtctcttggagatccttctttgtcttgttagtggtacatgggaagttatgtttttactggtgtgtgtgtgtgtgtgtgtgtgtgtacttaatgatgggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccatatcccacagactcactcatggagacccccttgtcaatatcccctctacctttactcctttgccctttcccaattcatcttctaccacctggattcttttccattcatgaacttcattcagcccttccaaagcccaagatttgcattcccttgacagggaggaaaggcaatggtaggaacctctggtggtctgggtgtctatgtgcctggtgaccagggctggatttttattactctgagcccactgctagtgaggagccttgaggggtggggacaggttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggctgtgagttttcatctcaaagtctgttccagagaaaggaaagtagtatagaggtgatttttagagaagctgagaccatgaaaacaagcctaatcccatccagaaactggggtaaagtctgaaagttcgttttcttcttcctccctgaataattgttccagaagggatgctaactctgccagagctacaggcagatttttgggctttggaagtggaagctgaggcctggggaaggctgggtaaggaatgctggggcaatctcagacagtaggcaggtgcttggcatgaatgagaagtgactttcctggagtccctcagtagaggatgagatagcagggattaggccacagtctcagatcctgatcttttttcttcctaggaaagcatacataacttgtgtctgcagaatcagtgtgggatgattttgctggcccaaggcttcagcgagagggagaagagaggtcactacagccctcctgtgggtaaaagcagctctcttataaacctgcctccatgcagtggggtgggggtaagggtgggtgacagcaaagaggttgaggaacctccctgggtttggggagtgagagcttccatgttcccttaatgtcctaggttaattcataaggcatctgagtcctgggtctcacccagcctcacagagagaaaaactgtccctgagggtgtcccctcccactcaaaggtagaaagagattgagccaggaactgccctcatatcctctgctctgccccttcccttccctttcctctgcccctcccacctaaagctgtttggggccctttctcagagccctgggtggtggcaggcagggaggagtcccaagatcctggtggccctgagccccatgctatggttgccagatttggcaaataaaaatacaggatgtccagttacatttgaatttcagttcaacaacaaacaattattaagtgtaaatatgtcctaggcaaatagttgggacatatactaaaaaataatttgttgtttatctgaaattcaaatgtaactggtcatcctgcattgtgtctgggaaccctaccctatgacttttccccctctccctttggtcccaaggggccaggaaccccaaggatttgacttaaccagttttttgaactgcaatattgagaaggggacactgtgacttgaagacacatgaattactttattttttaagcaacaacaaaataagaaccttctgaagccatttgagcctcatctgcccccatccgtgtatatttaattatatataaaagaagataattacctagaaacatatgaacagaatcttgtttaatcaagatgcatgtctataactttctgtaaatagccgcatggcaatgctgagagtccccttgatccccaacctcaaacccattttacagaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaa

SEQ ID NO: 6750 - DNA, 7598 bp, Homo sapiens
acttcggagccgagttggggcagcggtggagcggggacttcgcgcccccaggggaacgggcgcccctgcgaaaccgtcgccagccacgcgtccttgccgtccgacgccccctcacattggagaccccggatctctcccgcctccttcgggtcgctctccgctgtttcctctgccaccatgaggaacattttcaagaggaaccaggagcctattgtggctcctgccaccaccaccgccacgatgcccattggacccgtggacaactccactgagagtgggggtgctggggagagccaggaggacatgtttgccaaactgaaggagaagttattcaatgagataaacaagattcccttaccaccctgggcactgatcgccattgctgtggttgctgggctcctgcttctcacctgctgcttctgcatctgcaagaaatgctgctgcaagaagaagaagaacaagaaggagaagggcaaaggcatgaagaatgccatgaacatgaaggacatgaaagggggtcaggatgacgacgacgcagagacaggcctgactgagggggaaggtgaaggggaggaggagaaagagccagagaacctgggcaaactgcagttttccctggactatgattttcaggctaatcagcttactgtgggcgttctgcaggctgctgaactgcctgccctggacatgggaggcacctcagacccttatgtcaaggtcttcctccttcctgacaagaagaagaaatatgagaccaaagtccatcggaagacactgaaccctgccttcaatgaaaccttcaccttcaaggtgccataccaggagcttgggggcaaaactctggtgatggccatctatgactttgaccgcttctccaaacatgacatcattggagaggtaaaggtgcctatgaacacagtggacctcggccagcccattgaggagtggagagacctgcaaggcggggaaaaggaggagccggagaagctgggcgacatctgcacctccctgcgctatgtgcccacggccgggaagctcactgtctgcatcctggaggctaagaacctcaagaagatggacgtgggcggcctttcagacccgtacgtgaagatccacctgatgcagaatggcaagaggctcaagaagaagaagacaaccgtgaagaagaagaccctgaacccatacttcaacgagtccttcagctttgagatccccttcgagcagattcagaaagtccaggtagtggtcaccgtgctggactatgacaagctgggcaagaacgaagccataggcaagatcttcgtgggcagcaatgccacgggcacagagctgcggcactggtccgacatgctggccaacccccggaggcccatcgcccagtggcactcgctcaagcctgaggaggaggtggatgcactcctgggcaagaacaagtagacagcagcggctgggaccccacacctttcacggacactgacaagatccagagctatcaatacctcagttatgcaaccttagaggttttcttttttctttcatttgttgggtggttgtgtccttgtttttccttgtttttctctttttaaagaccaacttccctttgatggctgtgtgaggagagtcccctaagaggtgaaagagaagcctggctctgttcacggtcccaggagctgtccttgctgcatgccctgtcacagttccctcgactctttcaaagcttcacatctgcctcaccccaagcgaggctctctactggcacaaacttgcagcagttcctgttttttgagccttctggaccaacaaaatggcagcacatcctgcttcctgacagggaaggcatcacagtggccaatgatcgtgtgtgtgtgtgtgtgtgtgtgtgtgtatgtgtgtgtgtgtgtgtgtgtgtgtgtgtgtgtgtgtgtctttgagcatttctcttcattcctggaatgtgtgtgtgtgtgtgtctctttgagcatctctcttcattcctggaatgagccatggacagtaaagttgtgtgggaaaagaaggctctttggggaccctgacatgaagaagtccactaagtgggagatcttctctcatctatggcaaagtctcaggatcctgttcagatatcggggctttcatactcctgttggtggctatttgggaggcagcaagatgtgaagactggatgtgttcagaactaggaccaaacgatgccatcaaatacttcctcctgccagtcatggtttccccagaagtgtagttcctgggacattcatggatatgagctattcactagttgggtcagactaacagggactctcagtcccaaaatctcactcttattgacaataaatatcaaactatgaagaaacagaagtcccattaccagaaagaccaaaattaaactcctggatcttcaccccatccagtgggaaacacagatgctttctccctttccagaatataagcagccaagttcatttgcatttattccccattgtgcttttgcttctgtttctcttttaagtggagcaacactgtctgaagacacgttatctgtgcagagccagagaactttaaaaggaaagtttaaatgttcttagttctcctgaggtccaggtaagaagggggtggtaagaagaggatgggggacagatggctgagatcccttgggaggagatataggggagcactggaattcccccgactcccactccttgctcccttggccctctgccctccatgctggagagctgataggtagctggagtggcccagggagacctatgggaaggacccgtcctaccattagggggcttctctctatgaatgctaagaaacaaagggcatccattccaaatgagtagcagaggtgaccttctagggtttctacccatgctcagttgtatcccattccctgttcaccttttgtccccagcactgatataaaagccatatatatgttagtcaggtttgcactgagtcttcttccaatccttcagcctggacaacagagtgaggtccccttgtggccagaggccagccctccttgcctgccttcctttgacctctcttttccatccatgaagccctcaggcccttgccattttttcaccacagaaaactcatggcttctccagaagcctgagtatctctctttcccagcacaaatggcagcatctctatcctgccccatctgggccacttcagcttcctgtagacacccaagacagatggacagtgttggagggaatcaggctttgaggatccagtgtgaagaagttgcagagtgtctttttattttattttaaaaagggggaaggggcttttggttttgctttgttttttggatgaaggagtgagggaaatgagggaatacccccaccagaaacagactggaaagcctgcctgtctcttggagatccttctttgtcttgttagtggtacatgggaagttatgtttttactggtgtgtgtgtgtgtgtgtgtgtgtgtacttaatgatgggaaggtaagactctgatcaggattatgaactgcggtccttgggaccaaaggtgtggtcatggtagagagttgtaggacaatagggtgttttcagaatctgggtggccacagagtgggatttcctggtatggacatcagaagtcactggactcttctcccaaccccagagttatgggattttggtgctttctcagggtctctccccagactcactcttctcacccatatcccacagactcactcatggagacccccttgtcaatatcccctctacctttactcctttgccctttcccaattcatcttctaccacctggattcttttccattcatgaacttcattcagcccttccaaagcccaagatttgcattcccttgacagggaggaaaggcaatggtaggaacctctggtggtctgggtgtctatgtgcctggtgaccagggctggatttttattactctgagcccactgctagtgaggagccttgaggggtggggacaggttgctgagtgattttgaacgttgacaccagtgtggagccagtgtgggtgtggggagcagtgccttcctcaggtcccagctggtcctgatatgccacgtagtggatggcatctgtcttggtccatgggcttggtgggaacatgcttctgcttgtgtgttttccatacctgagggctgacgtagcttaaaccacagggcatcatgccaaacactcactgctgggcaggtttatttctggggatgtcagggtactggggtgtaggcactaagcaggatagagttagggtgtctggctagtaaggggttctggacgcctctggggctgtgagttttcatctcaaagtctgttccagagaaaggaaagtagtatagaggtgatttttagagaagctgagaccatgaaaacaagcctaatcccatccagaaactggggtaaagtctgaaagttcgttttcttcttcctccctgaataattgttccagaagggatgctaactctgccagagctacaggcagatttttgggctttggaagtggaagctgaggcctggggaaggctgggtaaggaatgctggggcaatctcagacagtaggcaggtgcttggcatgaatgagaagtgactttcctggagtccctcagtagaggatgagatagcagggattaggccacagtctcagatcctgatcttttttcttcctaggaaagcatacataacttgtgtctgcagaatcagtgtgggatgattttgctggcccaaggcttcagcgagagggagaagagaggtcactacagccctcctgtgggtaaaagcagctctcttataaacctgcctccatgcagtggggtgggggtaagggtgggtgacagcaaagaggttgaggaacctccctgggtttggggagtgagagcttccatgttcccttaatgtcctaggttaattcataaggcatctgagtcctgggtctcacccagcctcacagagagaaaaactgtccctgagggtgtcccctcccactcaaaggtagaaagagattgagccaggaactgccctcatatcctctgctctgccccttcccttccctttcctctgcccctcccacctaaagctgtttggggccctttctcagagccctgggtggtggcaggcagggaggagtcccaagatcctggtggccctgagccccatgctatggttgccagatttggcaaataaaaatacaggatgtccagttacatttgaatttcagttcaacaacaaacaattattaagtgtaaatatgtcctaggcaaatagttgggacatatactaaaaaataatttgttgtttatctgaaattcaaatgtaactggtcatcctgcattgtgtctgggaaccctaccctatgacttttccccctctccctttggtcccaaggggccaggaaccccaaggatttgacttaaccagttttttgaactgcaatattgagaaggggacactgtgacttgaagacacatgaattactttattttttaagcaacaacaaaataagaaccttctgaagccatttgagcctcatctgcccccatccgtgtatatttaattatatataaaagaagataattacctagaaacatatgaacagaatcttgtttaatcaagatgcatgtctataactttctgtaaatagccgcatggcaatgctgagagtccccttgatccccaacctcaaacccattttacagaactggttgaggctgctcctttgattttatgtcgtgtaaagtctttgttccccagccccacccctgcctcctcccatcgggaaaccccccatgggagtcatcagtgggcgggagtcggtgcctgctccagtccagccctgccttgggagatgctggaggaccctgtcgccctgaaggcctgtttgctgcacatctgcctgcagagccaaacctcagggcccggtgcagtgtccagcctggtatctggcatcccagtagcttccatgttctgtgtatgtgtgtggtgtgccccttcctcccactgtttgaattcactgaaaagccataaagggggcctcctgctggagatttggcctcccttggctcctcccaggagcccccatgtctctccaactggctccccacagaccacttctgaagggctcacctgttgtcactccctcctgctccctcagtcccgtgtcatgagaatggacggtgtccagggcttccggtggggtctcaggagatgcccatgctggccctgcccgagctggctttctcggcctgggttcacagttcagctccatctctacgctgggcgaggagcagacagcagtgggactccatggttctggatacctttcctggggtccctgtggaggcaaccaggattttcaggagcagccagtcagcagctcagccagggatgacagaaccatccctgcttactcacctctgtagtgtgagggtctgtgggtggtgatggaggagggactcagggagaggccggtgaatacaggggctgacgctcttccctcgtgcatcctcctgcagtctgacagaaagcagcccaatagcggggcaacctcagggctaccagcgatcccctgagagtggggtgggcaggttcagctgtgagagaggctcaggcagagcaggtgtggactaagtcccctgaccttcacacctgctccccagagaagccccagccagttgcaccaagtagcagaggtgagtagaggggcctgggggcttccaaggccccaggtcatcctgttgaactgagagggacaggtagcccccctgcctgcggcccctggccccatgggcacctgagggcagtactgcatgggaagagcccaggatgcctcaggcctggcaactgtgacaagtatgaggaaggagagagaacgggaagggaatcaggcagggcgcattcgaggaggccagaggtggcgaggcaggcttgccctgcacaaaccacaacagaagttgcacacagaagtcccagggacctttgtgctgggaactgaaagagtggggaaggtggaggggaccatttcagagcaggctggaatcaggtgcttggaccagtgaagacatgtcttgcttcctccagctctctctggggccctcccactctccacacccacagcagagacaaattgaggcaagagttgagagagcatctgtctggtgaggtgatgggagcagtgtgcatggggcaccaggagttcctccatcccacctgccttagcgatcaggactttaggggggcctcttcaaagatagtgacccttctgccctgactcctgcccatctaaggacttgatttgctgctttctgaaaaccctggggctgaaaacttcaaaatcagggcctggcagagcctagcttcgccaaggtcagcccaccaggagccctgccttcgtctccataggaaggacacatgtacagcccttgcccccggccctctcattcccacttctgcttggcaatgctctccatctcccttatgtggactcttgttcttgtctgatctcttgtcaaattgttattttgtaatgaactgcgtctccttattaaagaaatgagctgaaagaaa

SEQ ID NO: 6751 - DNA, 1424 bp, Homo sapiens
gcccctgccaggaatgcacctttagcccaggcctgctcagtgagctccgccgacagccagccctgctcctcccgccatgaccctgcagacccctctgggcttccaagttcctgggggctgcagtgaacatgctccacctgcatggctggcaaaccatgcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgccttctcctgcca

SEQ ID NO: 6752 - DNA, 993 bp, Homo sapiens
agactgcccggagctgcgcatgaacccaggccccgagacaagggtgaatgggctcacacaggccgagacaccggtgaatggtgtccaaagatgcagcaggacctggaaccggcactgggggccctcagcctgggactcggcctgtgtgaggggactgggggcacctttgcagatgtgtgcaatatcacccacactctcagaggattccagacacacaccactcagaaatgtgggctaggagcacccgctgcacctgcgctgagagagctgcagaaagggttaccagcccctcgggtggaaggagacagccggagctctcaggcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacgt

SEQ ID NO: 6753 - DNA, 1840 bp, Homo sapiens
atgccctcttccaagccaggcagccctgcacctcaggacccctccccgtcgtgcagaacctgctcaaaccaggttcagccaggccacctcctgctgcccctcaccaaggccagcctgacgggcccatcgccccctcctgcaaagctaggtagggctcagggtgcccccagccccaagggacccttggaaataggctggagcccagatgctcagcctctgcgtcttggggagaccttcctcccaaagggagttgcccagctatcacgggccagcagttccggccacaaggtggggttcctgcagccctggcccccgcaccccctcctaccccaggagagagttccccgtcaccagaggcagtgctgtccgagagctggacccgccttcgggtgtctgagaggaaggcctggtggctggccggccacaggaagtggtgggcgtcagcagggtagaaagatggggcacccaccagtctctcccagtgccccggccccagctggcaccacagctatacctgggcttattccagaccttgtcgccgggaccccctggccccgctgggctctcattgccggcgcccttgccgcgggcgtcctcctcgtctcctgcctcctctgtgctgcctgctgctgctgccgccgccacaggaagaagcccagggacaaggagtccgtgggtctgggcagtgcccgcggcaccaccaccacccacctggtgcaacctgatgtggatggcctggagtccagcccgggggatgctcagcaatgggggtgcctgcagctctccctggagttcgactttggaagccaggaggtgaagggccccgctgcgcaggaccagcggttctgcgagtttccggaaagggtgacgggggaagggcagaccccatgccctgggtggtggggagctgacagggcaggggcccttggctgagcccaccccgctggctcccagatcagggtgggcctgaggcaggcagccgacctgaggcctgggggcaccgtggacccctatgcccgggtcagcgtctccacccaggccggacacagacatgagacaaaagtgcaccgaggcacgctctgccccgtgtttgacgagacctgctgcttccacatcccgcaggcggagctgccaggggccaccctgcaggtgcagcttttcaacttcaagcgcttctcggggcatgagcccctgggtgagctccgtctgccactgggcaccgtggatctgcagcatgttctggagcactggtacctgctgggcccgccggctgccactcagcccgagcaggtcggggagctgtgcttctctctccggtacgtgcccagctcaggccggctgaccgtggtggtgctggaggctcgaggcctgcgtccaggacttgcagagccctacgtgaaggtccagctcatgctgaaccagaggaagtggaagaagagaaagacagccaccaaaaagggcacggcggccccctacttcaatgaggccttcaccttcctggtgcccttcagccaggtccagaatgtggacctggtgctggctgtctgggaccgcagcctgccgctccgaactgagcccgtaggcaaggtgcacctgggtgcccgggcctcggggcagcccctgcagcactgggcagacatgctggcccacgcccggcggcccattgcccagcggcaccccctgcggccagccagggaggtggaccgcatgctggccctgcagccccgccttcgcctgcgcctgcccttgccccactcctgaatgcaccacatgcctctgtctccccgctgagcccaggcacttgcccaggccgccctgcaggaccactgcaataaacgcc

SEQ ID NO: 6754 - DNA, 4461 bp, Homo sapiens
actccatgccgggtctctagttccagcgcgcctcggctcgctcgcgcggcgggagagttggcgcaaacctcgcggcagccgcagcctcctcgcgcgcctctccttcccctacgccctccgctcccgccatggggccaacgtggggctcctaagagttgccggctctcagcggcgcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccgccacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattgaatcagaaaaaaagtggaaggtttggtttcctcatttgaaatatatccgtactaatgaacaaacttgatgtgcacttttttatttgcttttattgttgattttttaactttgaacatcaatacattttacttgaatacatatagtccttagttgcataaggcattttatccttcgtatcaaatgcctgttagcacaaagagtgttttactatgttgtaattctttgcatatgaaatgtttttttaaacagttcatacttacctaaaattaaatatagtttatgctgctattgtataaagtagcacatgtcatatatgtatgggtttgattttgttatactgtgttcatttctagttgtgcaggtggttctgtataaacttaaaaggagattttgaacttaacttacacaacattaaatccttgcacaatcaaattaatgttacttatctgataatacttttctttcattctcagaaaattactttcttggtgaggtttggctctgctaaactcaaaacttgtctctcaagcttgttctttaaaatacatagacaaagctgtaaatttaaagaatcattttgaatataaatttaagaagtaatacttattggctgaaaaacggaggctgagccattgtggctaccattttacactgttttactgtaacattagctcaaatatctgttgcactgttcaactgatatttttaaaattctaataatcttcatctcaaatgtagcattagtatttctaagtgaacagaatcagaagttaatttttaagtgtttgtaaggttctcaagtactgtgacatgtatttttttgtgacgtgtattttttgtgacttgaagctatcatatagatcctgtatttctgatagaccatactaacagacaccaaaggaacaacaacactgtctgtgttcatcaccgtttagattgtacacagtaatggtgactcttaaacccagtcagaagctcatcattggaattcagtattttcttaaagaaaggatgatttattttcagcaacatatagaaatatactataaatattaataatacaacttcaatgcttaataataataaacaaattaattctaaaggcccaggcctccagtccttgcatgaaaggcatttgccttcataaggatcaaggttcaggccactacatgtaaaaactatgcaagtgtttttacaagacagaactttcttttaagtcaggtcaacatattttgtcccattttcaggccctgttggaaggtatctatactgaattaccccaaccttacttttaagatgtgtggtatagatagtatatatttcaagcttatttcaaaattggtggtttttttaaaaaaagaggcaagaaaataaaaacatatttacctggatgagaaaattttatcagcggttatgaaatttttatttttgtaaaatcccattatttctaaatattaaaaaaaagttttaaaagccttgaaattttgttgacatctcttatagtgatggcattactgttaattaagaggtaaatattttgcacattaccattttaaaggcaaacacagttctgcctcagatttttcaaaaatgcttataccaccctaaggaaaacaggtactcctagctaacattttctcattgaaaataatagaagaaagctgtttggaaacatttggctaccttgtcgagcctaaaagaattatttgctataggtaaaatgaaagatgacacttgcattttgaaattatttgttttattgggaaataaaacttttcaaataggaagacaaaaagttatactattaatagaatgacatttttggagacagttgttttattagtagatataactgcagcttaaagtaaattagcaattacgtttcctaagtgagtataattattttcacccaaaaacacatttttaaggactttttgttgattcttagaaactcgcttttctttactccctaaggagaaaaagccaatgcttgtgatgaaaaaatgtgaaccattggccaatcagaagactctaatatgggaattgtagattaaaataagttttaaaagaattttttaaatgtttccttgaagttagaataaactcatcatgcaaggatatgtgttaatcctgagaaagagatcagcgagaggaaattcaccacaactcatctttcatgtaattcaggaggtaggtttatgctcagattaataaggcatgattgttaaaaatgacagttcatattattaaaatgtaatcctaacaattttaatacaacacaccctcactctacacagcccacacattcatatacacataacttaccatctttctgcttgtaattgaagatgaaatattttcagtttcagtatttaaaataagatttgatattacaaatccccttatttgtgtgggacatcacattttaatgacagtactgacacattatgaagctgcagttcaggtatataatgaacatctaatttcagggacttcttcagggacttaccaaatatcagtctaggaaaaaaaagagtaa

SEQ ID NO: 6755 - DNA, 2433 bp, Homo sapiens
gcaatctccagccaaagtcaccgcgggcggactatggcttagggcgccagaggggttagaggtacgggaagaggaaaagacggctaactgggaaaaaaagagaaaacgaaagaaaagccaaacgatgagtttccacaaggaggacggagtgaacagtctgtgccagaaggctctgcacatcgtcaccgagctgtgcttcgccggccaggtggagtgggagaagtgctcgggcatcttccctcgggacaggggcagccagggcggaagcagcacagatatttcagtcagcctgttagctgtcgttgtcagcttttgtggactggccttgttggttgtctcactttttgtcttctggaagctgtgttggccatgctggaaaagcaaacctgtgacttccaacatcactacgcttccacagagcatttcaagtgctcctactgaagtttttgagactgaagagaaaaaagaaattaaggaaaatgaaaagccagccgtaaaagctattgagcctgcaataaaaatcagccacacttcccctgacatcccagcagaagtccaaactgctttaaaagaacatttaattaaacatgcacgtgtgcaaagacaaattactgagcctacgtcatcaacccgtggttggggaaagaagaagaagaaaagaattttgagcacttgcaattttgtcactatgccaaggcacccttcctgataatccttcaccaacctgcatgaaagtttctgaagaccacagcatgttgaaaaaaagaaaatgtactcatttttggctgccacaactatatattctttttaaaaccacagttccttccgaagacacctgccgaggcaaatgcaggtttccagtgttgattttagcatgggcacagaacctgttttacaacgaggagaaacaacaaccagcattgggaggataaagccagaactctacaaacagaaatcagttgactctgagggcaaccaaaacgaagatgtcaaaatctgtgggaaacttaactttaccctccagtatgattatgaaaatgaacttctagttgttaaaattatcaaagctttagatctccctgctaaagacttcacaggaacttctgacccttatgtgaagatgtatcttcttccagataggaaaaagaaatttcagacccgcgtgcacagaaagactttaaatcctctatttgatgaaacttttcaatttcctgtagcatatgatcaactaagcaaccgaaaactacatttcagtgtgtatgattttgacagattttctagacatgacatgattggggaagtgattcttgataatttgtttgaagtctctgatctctccagggaagccacagtatggaaagatattcactgtgctaccacagaaagtatagacctgggtgaaatcatgttttccctttgttacctaccgacggctgggcgtatgacattgacagtcattaagtgcagaaatctgaaggcgatggatattactggctcatcagatccttatgtcaaagtgtccctgatgtgtgaaggtcgaagattaaaaaagaggaaaacaactacaaagaaaaacactctaaaccctgtgtacaatgaggccattatttttgacatccctccagagaacgtggaccaggtcagcctctccattgcggtcatggattacgatagggtaggacacaatgaggtcataggagtgtgcagaacaggactggatgctgagggtcttgggcgagaccactggaatgaaatgctggcctatcatcgaaaaccaataacgcactggcacccattgctggagttacctggccgggcgaccagttttgatagtcaaggatcctgcccttctcctaaaccaccttccacaccataatgcctccaaaatgagaccatgatattaagcatctaggatcacgtgctcattgaatcagaaaaaaagtggaaggtttggtttcctcatttgaaatatatccgtactaatgaacaaacttgatgtgcacttttttatttgcttttattgttgattttttaactttgaacatcaatacattttacttgaatacatatagtccttagttgcataaggcattttatccttcgtatcaaatgcctgttagcacaaagagtgttttactatgttgtaattctttgcatatgaaatgtttttttaaacagttcatacttacctaaaattaaatatagtttatgctgctattgtataaagtagcacatgtcatatatgtatgggtttgattttgttatactgtgttcatttctagttgtgcaggtggttctgtataaacttaaaaggagattttgaacttaacttacacaacattaaatccttgcacaatcaaattaatgttacttatctgataatacttttctttcattctcagaaaattactttcttggtgaggtttggctctg

SEQ ID NO: 6756 - DNA, 5240 bp, Homo sapiens
agaaggcggagcctacctctcatcaggaccagtctgactgcacctgcatccttagctcagcgcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcagaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccatgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 6757 - DNA, 1322 bp, Homo sapiens
atccttagctcagcgcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaac

SEQ ID NO: 6758 - DNA, 3077 bp, Homo sapiens
ccccggcgtctccggccccgcctgcgctggggtcgctgcagtccccgcagctgccccgggctgcttgcccaggcgccccggccttattccagcctggggagcgcctcggtggggagcacgggacagcgagggaggccgaggcgggggccctgggcgcccgatatctccgaaccggggaggcggccccgattccgagagccggaacgcagggaaaggcaaggacggggcggccggcggaggggcgggcgccgctcatcagccacgccagtcacgtctggggccaccggctgcctttttcttcctttccccctttgctttcttccccctccgctgttggcgagggcaaagtggccgtggcggcgccatgcccgggccggagtgagtgcgcgcgggcgaaaatggcgtacatccagttggaaccattaaacgagggttttctttctagaatctctggtctgctgctgtgcagatggacctgccggcactgctgtcagaagtgctacgagtccagctgttgccagtcaagtgaggatgaagttgaaattctgggacctttccctgctcagacccctccctggctgatggccagccggagcagtgacaaggatggtgactctgtccacacggccagcgaagtcccgctgaccccacggaccaattccccggatggaagacgctcgtcctcagacacatccaagtctacatacagcctgacgcggaggatttcgagtcttgagtcaagacgtcccagctctccactcatcgatattaaacccatcgagtttggcgttctcagcgccaagaaggagcccatccaaccttcggtgctcagacggacctataaccccgacgactatttcaggaagttcgaaccccacctgtactccctcgactccaacagcgacgatgtggactctctgacagacgaggagatcctgtccaagtaccagctgggcatgctgcacttcagcactcagtacgacctgctgcacaaccacctcaccgtgcgcgtgatcgaggccagggacctgccacctcccatctcccacgatggctcgcgccaggacatggcgcactccaacccctacgtcaagatctgtctcctgccagaccagaagaactcaaagcagaccggggtcaaacgcaagacccagaagcccgtgtttgaggagcgctacaccttcgagatccccttcctggaggcccagaggaggaccctgctcctgaccgtggtggattttgataagttctcccgccactgtgtcattgggaaagtttctgtgcctttgtgtgaagttgacctggtcaagggcgggcactggtggaaggcgctgattcccagttctcagaatgaagtggagctgggggagctgcttctgtcactgaattatctcccaagtgctggcagactgaatgttgatgtcattcgagccaagcaacttcttcagacagatgtgagccaaggttcagacccctttgtgaaaatccagctggtgcatggactcaaacttgtgaaaaccaagaagacgtccttcttaaggggcacaattgatcctttctacaatgaatccttcagcttcaaagttccccaagaagaactggaaaatgccagcctagtgtttacagttttcggccacaacatgaagagcagcaatgacttcatcgggaggatcgtcattggccagtactcttcaggcccctctgagaccaaccactggaggcgcatgctcaacacgcaccgcacagccgtggagcagtggcatagcctgaggtcccgagctgagtgtgaccgcgtgtctcctgcctccctggaggtgacctgagggctgcagggaaggcagctttcatttgtttaaaaaaaaaaaaaaaagacggaaaaaaatgtgtcacatactattacatccacacctgcatacacactcgcaacatgtctacacacgtccacacacacagacacacagataccccaaatcctctcagaactgagaggaagctgactattgatcacaaaatggccgccctcagttgagtgaggcctaggaactttccggaagccccatccatagatcacaagctcagtgggctctgccgtgggacttattggcagtgcctgctcttgtcaatactcctgccccaaaatgcactttcaaccctcaggccagagaaaggacctcccaaagggtgccaagctccatcaagactaaatttaccaagagtttggccagtgtgtgggagacttgaacaccccccacttccgaaacacacacctactgggtaacttctgaacaggctgctgttccctggggttcttcaaacctgatacctttctccaaaggtgtaagtatctttgtcttctccgtagtaaatgtgataactagattatgggccatttggagaaaccaaatggcaaccaaaactattccagtgtcagaagcctttcctggcttaacagaattgttcttgtgttagctcatcccagggaacgccctgtgggtatgtatgtgtatgtcctcgtgcatgtgccctcacaggcgaacacgtgtgtgcctatgtgtcctcttggagagcatggcgatgggccaggacctcagccctgagcactgccttctctctgcctctcctgtccagtgagagtccaaccagtgtcctcctgtctgtcagagatcccactttggataaaagtagtgtgtgtgtgtgtgtgtgtgtgtgtgtgtgtgtgtaaagtaaataggatatgatagagcaaaagtaacattttttgaccgaatcatggtgattgtgacccacgaaagacatacaaagacttgatatatggattaaaatggctatcacaccccatccatgatgatcttcttccttaatcatactctgaggatctttctgtgtttttctgtgaacgaatgtcacgtctctcgtgctaaggaattagtgtagttagaatagatctctctctctctctctttctctctctctctttcctctctctctgttggatgcttctgtatctttttccacagcataatgtctggtgtgatggggagctatttattgaaattaaagattatttatttgtgcca

SEQ ID NO: 6759 - DNA, 3413 bp, Homo sapiens
gtcggttgcagctggcagtgcggcgggcgcgggcgccggagcgaggggcccgcgggcccggctattaataacgcggccgccagcccggggtcgcgcagccatggccagcccggagccccggcgcggcggggacggcgccgcccaggccgcgaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattgctagaggggcgtttccagcagtgtgtccaagctgtggcccagctggaagaggagagggatcagctcatccatgagcttgtattgctccgggaaccagccctgcaggaggtacagcaagtccatcaagacatcctggctgcctacaagctccatgcccaagcagagctggagagagatggcctaagggaggagatccggctggtcaagcagaagcttttcaaagtgacaaaggaatgtgtggcctaccaataccagctggagtgccgccagcaggacgtggctcagtttgccgatttccgggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataagggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtgaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagatagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttctcaacttgacagtctacctgtggtataactgtcaggtaaaaacatacatctttacaacttggtggtcccaagttaaaaaaaaaaaaaaaaaaaccaacaacaaaaaaaaaaacaccatttcacagacaggaaataaacaacatgaaaacagctcaagaaatacactaacgagcaaaaatatatgaatatatggggaaagaggaacgtgttgttttgacttaactgaagaaaccaagaggaaactggtctacgtatgaaaatgtgcatcctggaaagtcaggtgtcaagattttcgagtaggaatctatatgacttgaatctccccctatttcctgaataaaagtgacatctttcagtatttatacttcatggctcagacacctacctcatttggctctattccttactcactctagcctttacttaaatgagtctgaaaaacttggggatatagcataagaagaaaaataatcacacataatattcccctttctgtagctactttagacctgggttactagaaaattcctgaagaaaatttcaac

SEQ ID NO: 6760 - DNA, 3398 bp, Homo sapiens
cggacacccccaaacactcgcgggagaggggtgctggctccctttgagcagcccgcccaaccctgcctccaccctcccaggctggacagggaaggtgctccctggggcttcagaccccccttctgactccccctgcaacgggacctcacgaaaggaagggtggagagaaggttcgggaagacgagggggctgggaggtttggaaagacagctccaggcccccgttcccacccccgccccaggctggtccgggaggggcagcctctccccgcccccaggtccgcgcggccgctccctcctcccccggcaggagccccggccaagtgggcgcgcccggcccggggccggccgggatccggtgtcggttgcagctggcagtgcggcgggcgcgggcgccggagcgaggggcccgcgggcccggctattaataacgcggccgccagcccggggtcgcgcagccatggccagcccggagccccggcgcggcggggacggcgccgcccaggccgcgaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattgctagaggggcgtttccagcagtgtgtccaagctgtggcccagctggaagaggagagggatcagctcatccatgagcttgtattgctccgggaaccagccctgcaggaggtacagcaagtccatcaagacatcctggctgcctacaagctccatgcccaagcagagctggagagagatggcctaagggaggagatccggctggtcaagcagaagcttttcaaagtgacaaaggaatgtgtggcctaccaataccagctggagtgccgccagcaggacgtggctcagtttgccgatttccgggaagtgctgactacaagggcaacccagctctcagaggaactggcccagctccgggatgcctatcagaagcagaaggagcagctgcggcaacaactagaagcccctccaagccagagggatgggcactttctccaggaaagccggcgactctctgcccagtttgaaaatctcatggcagagagccgccaggacctggaggaggagtatgagcctcagttcctgcggctcctagagaggaaagaagctgggaccaaagctctgcagagaacccaggctgagatccaggaaatgaaggaggctctgagacccctgcaagcagaggcccggcagctccgcctgcaaaacaggaacctggaggaccagatcgcacttgtgaggcaaaaacgagatgaagaggtgcagcagtacagggaacagctggaggaaatggaagaacgccagaggcagttaagaaatggggtgcaactccagcaacagaagaacaaagagatggaacagctaaggctcagtcttgctgaagagctctctacttataaggctatgctactacccaagagcctggaacaggctgatgctcccacttctcaggcaggtggaatggagacacagtctcaaggggctgtttagaaatatatggccaaatctgtaacccggaaacagcaaaaaacttcttagcaaaggatcactaagtaccctttggatgtactcttccaaccagacaagagtgccagaaacttggcaagcaattcatcctgtggaagttgcaaatactggctgacctgcttaaaaagattctagagttggccggaggcagaacatgtcaactctttgctggattctatttcatctgctgttgatactgatctcaatgcaccaaggaaaggaaagatgagcctcctgtcttccagcaacaaccctcacatatgcactgagtgaaggatgaatgtatggacacatctgggagtattttaaagaatgtatcttgccttgtgttgacccaaaccaaaaacatttttgaggggcacatgtggggtcaaaaagatagccaatttccattacatgggtttacaatttccattcttttgtgccacgagtgttagaatttaaatgaatacttttacaaagtctactttttgttcaaggatatgctgacccatatagtttactcttaaaattgtgtcaaggtatttctcactatactctaaaacaactagacttgaaaagaaaccatttgagatttgaatctaatggttaacgctattcagattttcccaaagatcttacctcatgaaagtagttctgggtcagaatgatctactcagttaaaaaacaacaacaacaaaaaactaagcgattgggaaaaaacaggaattttatctggttattgcatctggtgatagaggccttcaaagcctattatttctaacctaagtaaaggccccagtgaaaaacatactggggaaataaaacctctgagaaaaggttcaagcaccttttccaaatttaaatcttgccttaaattctctctaccacactgcctttgacactcttggaagtccatgtagttctctacagatagacttcaaagaaacgttaccttatcaaagactaatctgtgccacctctgattcagtgttttatgtctttcactttccctgggaaggagtaaagttcttttctacagctctgggactattacatttaattctgctcttgatagtcaaagaccatggacaacaactgtcatctgaaggactcttctagaagccagagactggtgtttgatggatgttttatactaaataaaacccatcagcatggggttatgtagaaaagcaatttattccattttaagcacttacacagttagtcatggagagtaacaggcctgctggtgaaacaggtcacccaaaatggagatggcatcaaactagtggtcaaggactaactcctaaaaaaaaaaagcaactcttatcaaggattaatttaatttttaaaacaaatacaagttattgattcactcttctcaacttgacagtctacctgtggtataactgtcaggtaaaaacatacatctttacaacttggtggtcccaagttaaaaaaaaaaaaaaaaa

SEQ ID NO: 6761 - DNA, 569 bp, Homo sapiens
agctaagtggaaaaaggaatccgaaggaagaacgcctgaagcccaggtctgggaaggggcccagcagcttctctcttggggagaaagacgaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagcagagccccagcatggaggagaacctgagcatagaggacctggaattgctagaggggcg

SEQ ID NO: 6762 - DNA, 552 bp, Homo sapiens
cctttgagcagcccgcccaaccctgcctccaccctcccaggctggacagggaaggtgctccctggggcttcagaccccccttctgactccccctgcaacgggacctcacgaaaggaagggtggagagaaggaaaacaagagtagaggccaattctcctcttccaaagaactctggatccctaaatgaggcagaagccttgaacccagaagttactctatcttcagaggggtccttaaacctcgaagacattctctacctggaggacacaggtgaccttgatgagacactctatgtgcaagagactgagaaggcagaggaggccctgtatattgaggaggccatgcagccagatgaggctctgcatgtggaggagcctgggaatccagaggagacagtgtgtgtggaggaaaccacggagccagatcggatacagtttgtggaggggcccgtggagccaggaaagcccacaagcccagagcacgttgtttatgagggagagacagtcacaagggcggagaaatctaaccctgaggagagcctcagagccgagc

SEQ ID NO: 6763 - DNA, 482 bp, Homo sapiens
ggcactgccaccatgtccccgctgcgcccgctgctgctggccctggcccttgcctccgtgccttgcgcccagggcgcctgccccgcctccgccgacctcaagcactcggacgggacgcgcacttgcgccaagctctatgacaagagcgacccctactatgagaactgctgcgggggcgccgagctgtcgctggagtcgggcgcagacctgccctacctgccctccaactgggccaacaccgcctcctcacttgtggtggccccgcgctgcgagctcaccgtgtggtcccggcaaggcaaggcgggcaagacgcacaagttctctgccggcacctacccgcgcctggaggagtaccgccggggcatcttaggagactggtccaacgctatctccgcgctctactgcaggtgcagctgatgcattgctggtctctcatctgcagcttccacagagtgccaagcccctcactcagcccatccctg

SEQ ID NO: 6764 - DNA, 2167 bp, Homo sapiens
ggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtcta

SEQ ID NO: 6765 - DNA, 2086 bp, Homo sapiens
ggcgcgcaccgctctcttacactcgggcctcagaagtccgtgccagtgaccggaggcggcggcggcgagcggttccttgtgggctagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatg

SEQ ID NO: 6766 - DNA, 2160 bp, Homo sapiens
ggctgaaggcgggggcggtgccatgacgcgcctcgggggcggtcctcgggcgcgcaccgctctcttacactcgggcctcagaagtccgtgccagtgaccggaggcggcggcggcgagcggttccttgtgggctagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttacattttagtctgtct

SEQ ID NO: 6767 - DNA, 1277 bp, Homo sapiens
actcgggcctcagaagtccgtgccagtgaccggaggcggcggcggcgagcggttccttgtgggctagaagaatcctgcaaaaatgtctctctatccatctctcgaagacttgaaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggcagttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagct

SEQ ID NO: 6768 - DNA, 2103 bp, Homo sapiens
gggcgcgcaccgctctcttacactcgggcctcagaagtccgtgccagtgaccggaggcggcggcggcgagcggttccttgtgggctagaagaatcctgcaaaaatgtctctctatccatctctcgaagacttgaaggtagacaaagtaattcaggctcaaactgctttttctgcaaaccctgccaatccagcaattttgtcagaagcttctgctcctatccctcacgatggaaatctctatcccagactgtatccagagctctctcaatacatggggctgagtttaaatgaagaagaaatacgtgcaaatgtggccgtggtttctggtgcaccacttcaggggttggtagcaagaccttccagtataaactatatggtggctcctgtaactggtaatgatgttggaattcgtagagcagaaattaagcaagggattcgtgaagtcattttgtgtaaggatcaagatggaaaaattggactcaggcttaaatcaatagataatggtatatttgttcagctagtccaggctaattctccagcctcattggttggtctgagatttggggaccaagtacttcagatcaatggtgaaaactgtgcaggatggagctctgataaagcgcacaaggtgctcaaacaggcttttggagagaagattaccatgaccattcgtgacaggccctttgaacggacgattaccatgcataaggatagcactggacatgttggttttatctttaaaaatggaaaaataacatccatagtgaaagatagctctgcagccagaaatggtcttctcacggaacataacatctgtgaaatcaatggacagaatgtcattggattgaaggactctcaaattgcagacatactgtcaacatctgggactgtagttactattacaatcatgcctgcttttatctttgaacatattattaagcggatggcaccaagcattatgaaaagcctaatggaccacaccattcctgaggtttaaaattcacggcaccatggaaatgtagctgaacgtctccagtttccttctttggcaacttctgtattatgcacgtgaagccttcccggagccagcgagcatatgctgcatgaggacctttctatcttacattatggctgggaatcttactctttcatctgataccttgttcagatttcaaaatagttgtagccttatcctggttttacagatgtgaaactttcaagagatttactgactttcctagaatagtttctctactggaaacctgatgcttttataagccattgtgattaggatgactgttacaggcttagctttgtgtgaaaaccagtcacctttctcctaggtaatgagtagtgctgttcatattactttagttctatagcatacttgcatctttaacatgctatcatagtacatttagaatgattgcctttgattttttttttaaattctgtgtgtgtgtgtgtaaaatgccaattaagaacactggtttcattccatgtaagcattaaacagtgtatgtaggtttcaagagattgtgatgattcttaaattttaactaccttcacttaatatgcttgaactgtcgccttaactatgttaagcatctagactaaaagccaaaatataattattgctgcctttctaaaaacccaaaatgtagttctctattaacctgaaatgtacactagcccagaacagtttaatggtacttactgagctatagcatagctgcttagttgtttttgagattttttagtcaacacataatggaaacttctttcttctaaaagttgccagtgccacttttaagaagtgaatcactatatgtgatgtaaaagttattacactaaacaggataaacttttgactccccttttgttcatttgtggattaagtggtataatacttaattttggcatttgactcttaagattatgtaacctagctactttgggatggtcttagaatatttttctgataacttgttccttttcctgactcctccttgcaaacaaaatgatagttgacactttatcctgatttttttcttctttttggtttatgtctattctaattaaatatgtataaataaagttaca

SEQ ID NO: 6769 - DNA, 1404 bp, Homo sapiens
ctcaacactgggtcagaagtcacggccagacaagaaacggggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 6770 - DNA, 1519 bp, Homo sapiens
atcccagtccaaggtgagtcagctgaacaggggacaggcaccacccttcccagatcaggaagccagctgagagacagggctacgtttcagggagggaaacagattcagcagcggcagcagctggagaaggtcgtggagcagcaccttgcctgcagggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 6771 - DNA, 1295 bp, Homo sapiens
ggccgcgtggagccacgtctcctctcgcccctaggggagaagcgtggactggggacgtggggggacccggggacggctccatcctcctttccccatccctacccccaccccagtgtctcctgaggcacagggtccccacgggccgggctgaccccctgccccctggtgtctgcagacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 6772 - DNA, 1484 bp, Homo sapiens
cccttcccacggctgccttagtacagaatcttataagtcctcctccttcagaggctacaaatggtgttccgaggccaggggagtttaaagctcgatttcacccgcgcagcctccaatccgggtgttctgagaatcagccatgtcatccctgtacccatctctagaggacctaaaagtggaccaagccattcaggcccaggtcagagcctcacccaagatgccagccctgccagtccaggcaacagccatttccccaccaccagttttgtacccaaacttggcagaactggaaaattatatgggtctttccctctccagccaagaagtccaggagagcctgcttcagattccagagggtgacagtacagcggtctcgggccccgggcccggccagatggtggcaccggtaaccgggtacagcctgggcgtgcggcgagctgagatcaagcccggggtgcgcgagatccacctgtgcaaggacgagcgcggcaagaccgggctgaggctgcggaaggtcgaccaggggctctttgtgcagttggtccaggccaacacccctgcatcccttgtggggctgcgctttggggaccagctcctgcagattgacgggcgtgactgtgctgggtggagctcgcacaaagcccatcaggtggtgaagaaggcatcaggcgataagattgtcgtggtggttcgggacaggccgttccagcggactgtcaccatgcacaaggacagcatgggccacgtcggcttcgtgatcaagaaggggaagattgtctctctggtcaaagggagttctgcggcccgcaacgggctcctcaccaaccactacgtgtgtgaggtggacgggcagaatgttatcgggctgaaggacaaaaagatcatggagattctggccacggctgggaacgttgtcaccctgaccatcatccccagtgtgatctacgagcacatggtcaaaaagttgcctccagtcctgctccaccacaccatggaccactccatcccagatgcctgaagccactgcagggcagggcaggcagggggggcttcccgccctcctgcagcaaagggcaaccaccctcggatgatgggttgcagccggcctgctgcttaaggtgggggctgccatgaggggggcgtgtccaggagggtgaccatgggatggcttatacacacaggcctccttggagcctcagactccaagctaggctgaggctcaggcagggcccacaggcagccgattctcttgtgctgatttaaatgctggacacggaggcaggctgtttaaacgctgcttaaagtcgcaactgggcccctttcaagaaattttgctctaccaggaaaacagttacacattttaagagaacagagctacgttctttgtgagagctttttccttgccttgacttgctctttgtcacagactgcataagttgtcagccttgactatcttttgaataaagatttgattttaaacaaaa

SEQ ID NO: 6773 - DNA, 750 bp, Homo sapiens
atgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctga

SEQ ID NO: 6774 - DNA, 989 bp, Homo sapiens
gggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacct

SEQ ID NO: 6775 - DNA, 893 bp, Homo sapiens
gcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctga

SEQ ID NO: 6776 - DNA, 1136 bp, Homo sapiens
gggagggaaccagcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtgaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacct

SEQ ID NO: 6777 - DNA, 1241 bp, Homo sapiens
gcccgcgaacccaggccgggaggggggttcggcctgggggggaagggactgacatgtctctcgaagaccccttttttgtagtccgaggcgaggtgcagaaggcggtgaacacggcccgcgggctgtaccagcgctggtgcgagctcctgcaggaaagcgcggcggtcggacgcgaggagctggactggacgaccaatgagctgcggaatggcctgcgcagcatcgagtgggacctcgaggacctggaagagaccatcggtatagtggaagccaacccaggcaagttcaagctcccagccggggacctgcaggagagaaaggtgttcgtggagcggatgcgagaggcagtccaggaaatgaaggaccatatggtcagcccaacagccgtagcatttttggagaggaataacagagagatactcgcaggcaagccagctgcccagaagtcacccagcgacctgctggatgccagcgcagtctcggccacatctcgctacatcgaggagcagcaggccacacagcagctgatcatggatgaacaggatcaacagctggagatggtgtctgggagcatccaggttctgaagcacatgtccggccgcgttggagaagagctggacgagcagggcatcatgctggatgccttcgcccaagagatggaccacacccagtcccgcatggacggggtcctcaggaagttggccaaagtatcccacatgacgagtggtgagtcccctcaggggaggggtcagtcctggtgggggcaggttgtaggtggtaccctctccccgtgacccctgaccttctcgttcccagaccgccgacagtggtgtgccatcgccgtgctagtgggggtgcttctcctcgttctcatcttactattctctctctgaccccagccctccctggcaggctggtcccttaagcctggggagccaccaagcactttggagctggcctcgccccctaggaggagagggtccctcctgggtagctggagagtagagggtcccgcctggggagctgtccccatggctctcccctagagccagtgggacccttcaggaccctgggctggaaccaccaccactggtcctgtctcaagtgcacttagggggtggtggaggcagggacacctgagacacacctgtctccatttccagttccaggaccccaaagccatttgcccctgtgccttatacacgtgccaacctggaaataaaatgtcagccttttttata

SEQ ID NO: 6778 - DNA, 3079 bp, Homo sapiens
gcacgcagccttagctccttccccgcccttgctcttcccagtttctccgtcagcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgaccagggtgatctgattgatagcatagaagccaatgtggaaagctcagaggtgcacgtcgaaagagccactgaacagttacagcgagctgcttactatcagaaaaaatctcgcaagaagatgtgtatcctggtgcttgtcctgtcagtgattattctaatcttgggacttattatctggctagtttataaaacgaagtgattgcctccgatcgttctcccgctgagctgttttcaagggcaagtgcttgttgaagtcttgccagaacaaactgatcacaagaagacagcatatatcagaacgtcctgtaatcatttagttagaaactaactactaactagtctttggaattcgtgacctatggagacagtaattatcaatttattgattctattgatttctcaaattaggaattaacttatgtggattttgcttcctcttgtattctgattgcccttcatcccaagtgtttactgaaaattccattctagatattcttgttttgacaaatgacactacagtctcgtaatattgtcttttatgtatatacaaaatttacctttttactagcatctgagatagagttactttctggtacccagtatattggagtctgtcagaaactctataataggccaccagtttttattatttaacatttttatttgaatttctaagaagcctattctctatctattttgaaagattttggcactatatttaattggaaggtaaaatattgtacatgtgatccagagtaaatgagaagtctctatctgagctggtcagttactggagtacatgttactaatctgggtttaaagtttacttcattatctgctagtgtcatccacagcagttcatcctcatccacactaagccatcctgttagcttttaaaggaagttaatttaattaacattaatatactctatgggctccctctcccacctgtctgcatagaaaggcagaattagacatagcatgctttggaaaagcaaataggaattgttgggaatgatttaatcttgttgttgttgttgttgttgttcacttgtggttctacattcctggtgaatgatgaatgttgctgtcaaagggctgccccctaccttataagggttgctgggcatttgaaggcaggaagatttttaaagatagattgaggttggtttaaaattattcctgtaaaccaacaataaagcaaagaagaggttcatttttgtaaataacactggtttcaaatagtgatgttagacttaacctaatttataaacaagagattaatatctccatgcatagttttagacaaaaaaagatgtttcaataaaattactgtcttgtaatataaatgttgtccacttcccttttccacaggcctagaacagttaaagggaacataatttgtttaggctcccacataaatgtgaatctggccaacaactttggttcatcctttagtgaattagaggatttggctaccctgagtatatttatattcatttcttctgttctccttctgttattatacttaatcttctaaactaaactaatgtgaacagtagggaagcaagggcccaaatgcataagtttctttgcactgttgcacttacttaatacaaataaatgttttttaaagcttttgtagtatgtttttatgagttaacatcctaatgtggtaggtattaggtaatgtgctgtcatgagaaaaattgagacttccaagaaaactggacaccaggtgagggttggtttggagacggaataggtgtagctgcctttccttgaaaaacagtgtgtagagatggctgagtgcaatggctcacacttgtaatcccaacactttggaaggctgaggcgggaggatcagtatatcggtacgtctgagcccaagagttcaagatcagcctgggcagtatagcaagaccccatctccattttttttttaatgattttttaattaaaaaaaagaacaacaggatagagctgttggggtggcacagtggcccaaagagcagcttcagagataattccttggttctatgatccctgtttaactccaaattacagtcggacttggatacatcatttgtaacattgtaggaaagaaaaaagtcttggttgtgaaaaacgatttgcatttgggtaaaataaagtgaccatgcttttgttctgtaatactgtgtgacctgtggttgttgtaatggtgatcatggagagcaaatatgaacttggcctggattttaaatggcctagaatttgtggtagttgccaaagaggttctcctaggtggtcttaataaacctattcacagaattctcctta

SEQ ID NO: 6779 - DNA, 776 bp, Homo sapiens
gcctgcgggtcccggctggcggctgcttccggtaggagagcggtgtagagcgagcaggtctcagctcctcgtcatgtcatacggtcccttagacatgtaccggaacccggggccctcggggccccagctccgggacttcagcagcatcatccagacgtgcagcggcaacatccagcggatcagccaagccactgctcagataaagaatttgatgagccagctaggaactaagcaggactcaagcaagctacaggaaaatctgcaacagttacaacactccacaaatcagctcgccaaggaaacaaatgaattgctgaaagaattagggtccttgccccttcccttatctacttcagaacagcgccagcagagacttcagaaggaacgcctcatgaatgacttctctgcagccttaaacaatttccaggctgtgcagagaagggtatctgaaaaggaaaaggagagtattgccagagcaagagctggatctcgtctttctgcagaagagaggcaaagagaggagcagctggtctcatttgacagctctttgcttctggatatgaagaatgtggccctccaagactttattgatagcagaggactggagccctgccatgaggagtggaaccagatgcagagccaggaggatgaggtggccatcactgagcaggatttggaacttattaaagaaagagaaacggcaattcggcagctggaggctgacattttggatgtcaatcagatatttaaagatttggccatgatgatccatgacc

SEQ ID NO: 6780 - DNA, 2138 bp, Homo sapiens
cgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattactcctccaaagactgctgcccccagaacaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgggcatgagacagtctgcactgcgcctggtgaaatgcgtgtgtgtacagacagtccactgggcagcacaggtatcctcatgttctttatttgcacagagtgaaatgtcagaagttacatgtaaatgaattcacagtcaataaagtccacgtctacctggaaa

SEQ ID NO: 6781 - DNA, 4851 bp, Homo sapiens
cgggactggaggctgccgagggggccggcgcccgagtccgggattcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaaggagaggtacagaaagcagtcaacactgcccagggattgtttcagagatggacagagctcctccaggacccctccacagcaacaagggaagaaatcgactggaccaccaacgagctgagaaataacctccggagcatagagtgggatctagaggaccttgatgaaaccatcagcatagttgaagcaaatcctagaaaatttaaccttgatgcaactgaattgagtataagaaaagccttcattacaagtactcggcaagttgtcagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatctggatagagttctagctttgacttctcatttccttgtctttttgggtgcattcctcagcacactttttttttaaacctttttgttttgttttgtttgtatttcatgtggttttatttgggggttttggttttttcacccttttttgtgatttgcaatgatgtgcttgcccagctaacttttgaattgcactttttaataaatattcttaacaatttttgaagaaggatattttatctcatttgagatcatggtaggttaagaaaatatgcctgttgatgaaagctaaaagcaaatttatgaaactaaaagggtgattgacatccatgtttacactccgctctaatgtttgatatataaataagttattttcaaattaggaaaaaacagtgagtattacaaagggcttcagatgtttagagtactaggttatttatgttttacaaagtttgaatcttctataaactaagaaaggggatgatccttagatttgcattaaaatatagaagtcttttaaagtaaatgtgaaccttgtctaagtactgtaatccacacaacacattataagaagcaaaccagcatcttaaggaattataaaattaccctatttaaaagccatgctattgttctgctattaccagatttattgtgccacacaaaaggatcatgtgtgtcagcaggggccgtttggaacaaacctagtcattaatgagtaagatactcctgttagttcagggaccaagttttatgacccagaggcttaatgatgtttggatatatttcaaatcggcgtgcttacctcactgatttaaattattttctaaatagtggccattgtagacctgactcaggctgaagctaaatagagaacaatttagaaagttaactaacaatacagtgcattctacccgtagggccaccatgcccttctgcccctggctgatttgatcctgtgtctgatcccattgcaccctgactgggcagtccctacagaaccagtgttaatttgaagggcctccactcaggctccaaatgtggcagccaaagagaacaatccagggaacctacatttatttttaaggacaaatatttcctcctcagtggtcctaatgttcagggctttagagggaacccaggtggtctcttcaccctgtgtcctagaatgggagagtaagtagacagtggtgataaccccacactgcttataagtgcatctttatagtatttggggctttcctacccctttagccttctgtacctagtaccatattccagttttaaagaactggcagaatgtgatggataacagaggaagagctcaatttatgtttattggaagaacattttacttaaatgatttgaggggtgggagggagtgaactactgagtttgccagagtgaaaatccatctgaaaaactcagctacctttagtttttagtcctcatttttggtcttgtctctgcggactgtgaagaatcacaatgctctatatgccctggactgtgtggcaaatgcaggttgcagcgtgtgtgttacatgaggatcttccacaatttcagaatgcacgccagagctgaagggggaaacttggtaacttgcccattattctctgcttttagccagagttaaacagactgatgggtctggtagccaacaacttggcaacttccactccttctcacctcgtgagattaagggctgtgaaaagaaatctagtctaactccaacagaaatctgtctctgttaagtgttttaccttctgtaagtagagatggtagagccaagatttttcttttggtaatttccctgtctataaagtgagaccaaagggatatctgttccctgttacctttttggagaattcataacatttgaagatcaaaaaattgaatgataaatatgaatggcttttcaattctgtggactttgtaccatttggcttcaccttgtactgcaagatgaatttgtaaacaaaacaaaattggactgtctggaaagctaaagttctgaaatatggaatgtactgcctctaatttttctttgtcttcctctcactggcatttttttctctcccaggtttcttaagaataatgttttttaaaggaggctttttgcccatcaagaataaaaagaaataaaaccaaagggttaccggacttaagcccccgcagtcactgtgcgccatccctgagcaaagtccgcccctgaggacagtgcccctgccccagtgacaggccttactcctcccagggcctttgcttctaatagggggtggtctttcttttctttctctcctttttttttttttgattaaaaaataaaaccaaaccagaatttgctgaaagcaggtacctttcagtagctccgatcagagtaactcagcttagagatactgttactcaggacaacagtatgtacaaaagtctccggaaaaggaaaataaaacaacctgaaaagaa

SEQ ID NO: 6782 - DNA, 979 bp, Homo sapiens
attcggccagtggtgctgagcgagtgctggaccagcggccgtcctgtgcacctggcctgtgcgcgtgcccgctgctcggcttcacccagactaaggcgcgggcagctgcgggaacaggcggggtgggcggagggagaccgggaggcacgggcgccctgtgcgcggaggaggtgaaggcggccggggccgggacgccatgtccatggaggaccccttctttgtggtgaaagggacatgaaagatcagatgtcaacttcatctgtgcaggcattagctgaaagaaaaaatagacaggcactgctgggagacagtggcagccagaactggagcactggaacaacagataaatatgggcgtctggaccgagagctccagagagccaattctcatttcattgaggagcagcaggcacagcagcagttgatcgtggaacagcaggatgagcagttggagctggtctctggcagcatcggggtgctgaagaacatgtcccagcgcatcggaggggagctggaggaacaggcagttatgttggaagatttctctcacgaattggagagcactcagtcccggctggacaatgtgatgaagaaacttgcaaaagtatctcatatgaccagtgatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttg

SEQ ID NO: 6783 - DNA, 2478 bp, Homo sapiens
agtaggttgggagtggaaggtggtggctgctgctccgcagtgtcgggaagatggcgccgccggtggcagagagggggctaaagagcgtcgtgtggcagaagataaaagcaacagtgtttgatgactgcaagaaagaaggcgaatggaagataatgcttttagatgaatttaccactaagcttttggcatcgtgttgcaaaatgacagatcttctagaagaaggtattactgttgtagagaatatttataagaaccgtgaacctgtcagacaaatgaaagctctttatttcatcactccgacatcaaagtctgtagattgtttcttacatgattttgcaagtaaatcggagaacaagtataaagcagcatatatttacttcactgacttttgccctgataatctctttaacaaaattaaggcttcttgctccaagtcaataagaagatgtaaagaaataaatatttccttcattccacatgaatctcaggtgtatactcttgatgtaccagatgcattctattactgttatagtccagaccctggtaatgcaaagggaaaagatgccattatggaaacaatggctgaccagatagttacagtgtgtgccaccttggatgaaaatcccggagtaagatataaaagtaaacctctagataatgccagtaagcttgcacagcttgttgaaaaaaagcttgaagactactacaagattgatgaaaagagcctaataaagggtaaaactcattcacagctcttaataattgatcgtggctttgatcctgtgtccactgtcctgcatgaactgacctttcaggcaatggcatatgatctactaccaattgagaatgatacatacaaatataaaacagatggaaaagaaaaggaggccatccttgaagaagaagatgacctctgggttagaattcgacatcgacatattgcggttgtgttagaggaaattcccaagcttatgaaagaaatttcatcaacaaagaaagcaacagaaggaaagacatcacttagtgctcttacccagctgatgaaaaagatgccccatttccgaaaacagattactaagcaagttgtccatcttaacttagcagaagattgcatgaataagttcaagcttaatatagaaaagctctgcaaaactgaacaggacctggcacttggaactgatgcagaaggacagaaggtgaaagattccatgcgagtactccttccagttctactcaacaaaaatcatgataattgtgataaaataagagcaattctactttatatcttcagtattaatggaactacggaagaaaatttggacaggttgatccagaatgtaaagatagaaaatgagagtgacatgattcgtaactggagttaccttggtgttcccattgttccccaatctcaacaaggcaaaccgttaagaaaggatcggtctgcagaagaaacttttcagctctctcggtggacaccttttatcaaagatattatggaggatgctattgataatagattagattcaaaagaatggccatattgttcccagtgtccagcagtatggaatggttcaggagctgtaagtgctcgccagaaacccagagctaattatttagaagaccgaaaaaatgggtcaaagctgattgtttttgtaattggagggatcacatactctgaagtgcgttgtgcttatgaagtttctcaggcacataaatcctgtgaagttattattggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaatta

SEQ ID NO: 6784 - DNA, 2342 bp, Homo sapiens
cccttctgacccaccccgctaggtagtcccacacggcggccctcggctcccgggccccgccccggcctcctgcatttgcccgaggccccctccccagcactggccacaccccagggtagccccgcccccagagctcctcccccagcggccggggtagggtggcggctggcccagccgggcccccgctgccctctgccctgggcgcttggtcggagcgggctgggcaaagcgggacagggcgagcgcggcggcccgggggctcggaggcgaagatggcgtccggcaggcgcgccccgcgcaccgggctgctggagctgcgcgccggggcgggctcgggggccggcggcgagcgatggcagcgggtgctgctgagtctggcggaggacgtgctgaccgtgagccccgccgacggcgaccctggtcccgagcccggcgctccgcgggagcaggagcccgcgcagctcaacggcgccgcggagccgggcgccgggcccccgcagctgccagaggcgctactgctccagcggcgccgcgtgacggtgcgcaaggccgacgccggtgggctgggcatcagcatcaaaggcggccgggagaacaagatgcctattctcatttccaagatcttcaagggattggcagctgaccagacagaggccctttttgtgggggatgccatcctgtctgtgaatggggaagacttgtcctctgctacccatgatgaggcggtgcaggtcctcaagaagacaggcaaggaggtggtgctggaggtcaagtatatgaaggacgtctcaccgtatttcaagaactctactggtgggacctcggtcggctgggactcacctcctgcctcaccccttcagcggcagccttcctcccctggccccacaccccggaacttcagcgaggccaaacacatgtccttgaagatggcatatgtctcgaagaggtgcacccccaatgacccggagcccaggtatctggagatctgctcggcagatggtcaagacaccctcttcctgagggccaaggatgaggctagtgcgaggtcgtgggcgactgccatccaagcccaggtcaatactctgacgccgcgggtcaaggatgagctgcaggcactgttggcagccaccagcacagctgggagccaggacatcaagcagattggctggctaactgagcagctgcccagtgggggcacagcccccaccctggccctgctaactgaaaaggaactgctcctctacttgtctctccccgagacccgcgaggccctgagccggccagcccgtactgccccactcatcgccaccagactggtgcactcaggcccctccaagggctcagtgccctacgatgcagagctctcttttgccctgcgcacgggcacgcgtcacggtgtggacactcacctgttcagcgtggagtcaccgcaggagctggctgcctggacccgccagcttgtggatggctgtcaccgggccgccgagggtgtgcaggaggtgtctacagcctgcacgtggaatgggcgtccctgcagcctgtctgtgcacatcgacaagggcttcacactgtgggcggctgagccaggtgcagcccgagctgtgctcctgcgacagcccttcgagaagctgcagatgtcttcagatgacggtgccagtctccttttcctggattttggaggtgctgaaggcgagatccagctggacctgcactcgtgtcccaaaaccatagtcttcatcatccactccttcctgtcggccaaagtcacccgcctcgggctgttggcctagaagtcgccggatgcactagccctgaagaggggtgtccatgacatggcctgagctgggcctccaccgactgcctgctcacccctgggctgagggaagggagaggagaggaacaagggcctccgaaaccccaaccctgagggagactggattggtcttggggcccaggacccagacgcaggacagagtggactctgcctgtgatggggtggccttcctgctgcccccctccaccagtgccttttgcagagagatattttgtgtacacagaagccattccgagtctgggacctgcccctgtgcggatcctgaccccagccaacagctgagctgccgggcctcctcgaggcccctaagccacccccagaggtcccatctgaagctggagtaccctggggtcagcagcaagagaaagaagaggagattttctgtttgtttttcccctcagccctgccaccgtggggagtctggtttttctcttcatcctgtctctctcctccttactcttggataaataaacagcctgtgagcacacaggcagcccggcccagtgta

SEQ ID NO: 6785 - DNA, 1888 bp, Homo sapiens
gcccgagccggagccggcagaggggcgcgggcgcggacgcggcgcctggcggggccctgggaggctcggacggggtcctggcgttgagctcggccggcccggagcgcggacccagccgcaggggcggcgatgggcaccgagggacccccgcccccggccgcctcccgcggacgccagggctgcctgctggtacctgcgcggacgaaaaccactattgctctgttgtatgatgaagagtccgaaaatgcctatgacatccggctgaagctgacgaaagaggtgctgacaattcagaaacaagatgttgtctgtgtgggcggaagccaccagggcaggaatcgcagaactgttacactccgcagacagccagttggcggcttgggcctgagtataaagggaggttctgagcacaacgtccctgtcgtcatatcaaaaatattcgaagaccaagcagctgaccagacagggatgttgttcgtaggagatgctgttctccaggttaatggcatacatgtagaaaatgcaactcatgaagaagtggtgcatctgctgagaaatgctggcgatgaagttaccatcaccgttgagtatctcagggaagcgccggcatttctgaagctcccgttagggtccccagggccatccagcgaccacagcagtggggcctcctctcccctctttgacagcggtttgcatctgaacggaaactccagtaccacagccccatcgtcaccttcctcgcccatagctaaggacccgaggtatgagaagcgctggctggacaccttgtccgtgcctctgtccatggctcgcatctcaaggtacaaagccggaacggaaaaattaaggtggaatgcgttcgaggtgctcgccctggacggagtcagctctgggatcctccggttttacacagcccaggatggcaccgactggctgcgggcggtctcagccaacatcagggagctgacacttcagaacatgaagatggcgaacaaatgctgctctccttccgaccaggttgtgcatatggggtgggtaaatgagaaactccaaggagctgactcctctcaaaccttcagacccaagttcctagcactgaagggcccgtccttctacgttttcagcactcctccggtgagcacattcgattgggtgcgagcagaaaggacctatcacctctgtgaggtgctatttaaagttcacaagttctggctcacagaggactgctggttgcaagcaaacttgtatctgggtcttcaagattttgactttgaggaccagaggccctattgcttcagcatcgtggccggccatgggaagagccatgttttcaacgtggagcttggcagcgagctggccatgtgggagaagtccttccaaagagccacgttcatggaagttcagagaaccgggtccagaacatacatgtgcagctggcaaggagagatgctgtgtttcacggtggatttcgcgttgggatttacctgttttgagagtaagaccaagaatgtgctctggagatttaaattttcccagcttaagggatcttcagatgatgggaaaactcgagtaaagctgctgtttcagaatctggacaccaaacagattgagacgaaggaactcgagttccaggacctgagggctgtcctgcactgcatccactccttcatagcagccaaggtggcctccgtggaccccggcttcatggacagtcagagtcttgccagaaaatacatgtacagcagctaaaggttgtttctgttgagtgctgaaaaattaaattattttcgtaagaaatgattctttcctgcagaatattgcaactttgtgttgttttatgatgagcctatagttgtgataccaataaaacatgtcactagtttccaaa

SEQ ID NO: 6786 - DNA, 758 bp, Homo sapiens
aggacctgaaaaacgtgttcccacccgaggtcgctgtgtttgagccatcagaagcagagatctcccacacccaaaaggccacactggtgtgcctggccacaggcttctaccccgaccacgtggagctgagctggtgggtgaatgggaaggaggtgcacagtggggtcagcacagacccgcagcccctcaaggagcagcccgccctcaatgactccagatactgcctgagcagccgcctgagggtctcggccaccttctggcagaacccccgcaaccacttccgctgtcaagtccagttctacgggctctcggagaatgacgagtggacccaggatagggccaaacctgtcacccagatcgtcagcgccgaggcctggggtagagcagactgtggcttcacctccgagtcttaccagcaaggggtcctgtctgccaccatcctctatgagatcttgctagggaaggccaccttgtatgccgtgctggtcagtgccctcgtgctgatggccatggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaattgtgtgttgggcctggttgcattt

SEQ ID NO: 6787 - DNA, 720 bp, Homo sapiens
gaagtcagcctcataccaaaccatccgtttttgtcatgaaaaatggaacaaatgtcgcttgtctggtgaaggaattctaccccaaggatataagaataaatctcgtgtcatccaagaagataacagagtttgatcctgctattgtcatctctcccagtgggaagtacaatgctgtcaagcttggtaaatatgaagattcaaattcagtgacatgttcagttcaacacgacaataaaactgtgcactccactgactttgaagtgaagacagattctacagatcacgtaaaaccaaaggaaactgaaaacacaaagcaaccttcaaagagctgccataaacccaaagccatagttcataccgagaaggtgaacatgatgtccctcacagtgcttgggctacgaatgctgtttgcaaagactgttgccgtcaattttctcttgactgccaagttatttttcttgtaaggctgactggcatgaggaagctacactcctgaagaaaccaaaggcttacaaaaatgcatctccttggcttctgacttctttgtgattcaagttgacctgtcatagccttgttaaaatggctgctagccaaaccactttttcttcaaagacaacaaacccagctcatcctccagcttgatgggaagacaaaagtcctggggaaggggggtttatgtcctaactgctttgtatgctgttttataaagggatagaagga

SEQ ID NO: 6788 - DNA, 537 bp, Homo sapiens
cttgggagtcccctaagacacatcttcagtcacttctctctgcctgtgtctcaggaaaccagctcctcctactgtcttctgtgctagggatcacttccttgttgagtggggcctgagttttaagaggatcttctgctcctcttcatctggtccgtttccttccaaggcccccgagaggaaggcatgcggtgggccctactggtgcttctagctttcctgtctcctgccagtcagaaatcttccaacttggaagggagaacgaagtcagtcaccaggcagactgggtcatctgctgaaatcacttgcgatcttactgtaacaaataccttctacatccactggtacctacaccaggaggggaaggccccacagcgtcttctgtactatgacgtctccaccgcaagggatgtgttggaatcaggactcagtccaggaaagtattatactcatacacccaggaggtggagctggatattgagactgcaaaatctaattgaaaatgattctggggtctattactgtgccacctgggacagg

SEQ ID NO: 6789 - DNA, 897 bp, Homo sapiens
actctgggagggctaaggagccatcatgatccctaagctgctttccctcctctgtttcagactgtgcgtgggccaaggagacacaaggggagatgggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcgcagtgacgtccttctactgttggtgacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacagttcccccaggtaccacatcgagcaactactccctgggtaacttcgtacgactgggtctggctgccgtaattgtggttatcatgggagctttcctggtggaggcctggtacagccggaatgtgtctccaggtgaatcagaggccttcaaaccagagtgactccatcttgaaccggggctgggtaaactgaggctgcaacctgctggactgcattc

SEQ ID NO: 6790 - DNA, 896 bp, Homo sapiens
atgaaagaaagaaaaaagaaagaaagaaaggaaagaaaaagaaagaaagaaagaaatggactgtgcgtgggccaaggagacacaaggggagatgggtcactgcccaagccgtccctcagtgcctggcccagctcggtggtccctgccaacagcaatgtgacgctgcgatgttggactcctgccagaggtgtgagctttgttctcaggaagggaggaattattctggagtccccgaagccccttgattctacagagggcgcggccgaatttcacctcaataatctaaaagtcagaaatgctggagagtacacctgtgaatactacagaaaagcatccccccacatcctttcacagcgcagtgacgtccttctactgttggtgacaggacatttatctaaacctttcctccgaacctaccaaaggggtacagtgaccgcaggtggaagggtgactctgcagtgccagaagcgagaccaattgtttgtgcctatcatgttcgctctactgaaggcagggacgccatcacccatccagctgcagagtccagcggggaaggagatagacttctctctggtggacgtgacagccggcgatgctgggaactacagctgcatgtactaccagacaaagtctcccttctgggcctcagaacccagtgatcagcttgagatattggtgacagttcccccaggtaccacatcgagcaactactccctgggtaacttcgtacgactgggtctggctgccgtaattgtggttatcatgggagctttcctggtggaggcctggtacagccggaatgtgtctccaggtgaatcagaggccttcaaaccagagtgactccatcttgaaccggggctgggtaaactgaggctgcaacctgctggactgcattc

SEQ ID NO: 6791 - DNA, 1297 bp, Homo sapiens
gaagcgcctgtgcgtgcgtggggcgtagcaagggacggaagctctgcctgtgcgaccgccgcccacccgagcctatctgggctgcgtcttctcgccgctgctcttcgtggcccaacgccccaatccttgcgtgtgcttgcagtcccaccccacactcagccttgtgtccctcgatccagtctccgacttccatttcccaccctaaaccgcctacccggtgtctgttccccgcccggttgtcctcgccctgctgcgctgagtgtcccctgttagcctcgaccccatggcgctgcagacgctgcagagctcgtgggtgaccttccgcaagatcctgtctcacttccccgaggagctgagtctggctttcgtctacggctccggggtgtaccgccaggcagggccgagttcagaccagaagaatgctatgctggactttgtgttcacagtagatgaccctgtcgcatggcattcaaagaacctgaagaaaaattggagtcactactctttcctaaaagttttagggcccaagattatcacgtccatccagaataactatggcgctggagtttactacaattcattgatcatgtgtaatggtaggcttatcaaatatggagttattagcactaacgttctgattgaagatctcctcaactggaataacttatacattgctggacgactccaaaaaccggtgaaaattatctcagtgaacgaggatgtcactcttagatcagccctcgatagaaatctgaagagtgctgtgaccgctgctttcctcatgctccccgaaagcttttctgaagaagacctcttcatagagattgccggtctctcctattcaggtgactttcggatggtggttggagaagataaaacaaaagtgttgaatattgtgaagcccaatatagcccactttcgagagctctatggcagcatactacaggaaaatcctcaagtggtgtataaaagccagcaaggctggctggagatagataaaagcccagaaggacagttcactcagctgatgacattgcccaaaaccttacagcaacagataaatcatattatggaccctcctggaaaaaacagagatgtggaagaaactttattccaagtggctcatgatcccgactgtggagatgtggtgcgactaggcctgaagaagtcagtgatttatagttcactaaaactgcacaaaatgtggaaagggtggctgaggaaaacatcctgattttgcttgcttttatatatgttatgtgtagatgaataaagtgtttgatcctttttgacagaa

SEQ ID NO: 6792 - DNA, 3256 bp, Homo sapiens
aatcccaattactgtgttcgctgctcagggctcctcattcccctttagagtaaagggcgagggcaacagtggacggggtgtctccagacatccccctcattaccgtggccgcggaagccgactcggcagttgccgccgcggctgtggtgactaccagacgggccataggcgtgcgcacgcgcacccgcaccggcgcgccggccgtcggtcacgtggcctccggccagggcttgcgaagccggaagtgtcctgagtctcgaggaggccgcgggagcccgccggcggtggcgcggcggagacccggctggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatgcctatggactaccagaatctgaattcttaattgttttgcgagatgtggtgggtggaatgaatcatctacgagagaatggtatagtgcaccgtgatatcaagccaggaaatatcatgcgtgttataggggaagatggacagtctgtgtacaaactcacagattttggtgcagctagagaattagaagatgatgagcagtttgtttctctgtatggcacagaagaatatttgcaccctgatatgtatgagagagcagtgctaagaaaagatcatcagaagaaatatggagcaacagttgatctttggagcattggggtaacattttaccatgcagctactggatcactgccatttagaccctttgaagggcctcgtaggaataaagaagtgatgtataaaataattacaggaaagccttctggtgcaatatctggagtacagaaagcagaaaatggaccaattgactggagtggagacatgcctgtttcttgcagtctttctcggggtcttcaggttctacttacccctgttcttgcaaacatccttgaagcagatcaggaaaagtgttggggttttgaccagttttttgcagaaactagtgatatacttcaccgaatggtaattcatgttttttcgctacaacaaatgacagctcataagatttatattcatagctataatactgctactatatttcatgaactggtatataaacaaaccaaaattatttcttcaaatcaagaacttatctacgaagggcgacgcttagtcttagaacctggaaggctggcacaacatttccctaaaactactgaggaaaaccctatatttgtagtaagccgggaacctctgaataccataggattaatatatgaaaaaatttccctccctaaagtacatccacgttatgatttagacggggatgctagcatggctaaggcaataacaggggttgtgtgttatgcctgcagaattgccagtaccttactgctttatcaggaattaatgcgaaaggggatacgatggctgattgaattaattaaagatgattacaatgaaactgttcacaaaaagacagaagttgtgatcacattggatttctgtatcagaaacattgaaaaaactgtgaaagtatatgaaaagttgatgaagatcaacctggaagcggcagagttaggtgaaatttcagacatacacaccaaattgttgagactttccagttctcagggaacaatagaaaccagtcttcaggatatcgacagcagattatctccaggtggatcactggcagacgcatgggcacatcaagaaggcactcatccgaaagacagaaatgtagaaaaactacaagtcctgttaaattgcatgacagagatttactatcagttcaaaaaagacaaagcagaacgtagattagcttataatgaagaacaaatccacaaatttgataagcaaaaactgtattaccatgccacaaaagctatgacgcactttacagatgaatgtgttaaaaagtatgaggcatttttgaataagtcagaagaatggataagaaagatgcttcatcttaggaaacagttattatcgctgactaatcagtgttttgatattgaagaagaagtatcaaaatatcaagaatatactaatgagttacaagaaactctgcctcagaaaatgtttacagcttccagtggaatcaaacataccatgaccccaatttatccaagttctaacacattagtagaaatgactcttggtatgaagaaattaaaggaagagatggaaggggtggttaaagaacttgctgaaaataaccacattttagaaaggtttggctctttaaccatggatggtggccttcgcaacgttgactgtctttagctttctaatagaagtttaagaaaagtttccgtttgcacaagaaaataacgcttgggcattaaatgaatgcctttatagatagtcacttgtttctacaattcagtatttgatgtggtcgtgtaaatatgtacaatattgtaaatacataaaaaatatacaaatttttggctgctgtgaagatgtaattttatcttttaacatttataattatatgaggaaatttgacctcagtgatcacgagaagaaagccatgaccgaccaatatgttgacatactgatcctctactctgagtggggctaaataagttattttctctgaccgcctactggaaatatttttaagtggaaccaaaataggcatccttacaaatcaggaagactgacttgacacgtttgtaaatggtagaacggtggctactgtgagtggggagcagaaccgcaccactgttatactgggataacaatttttttgagaaggataaagtggcattattttattttacaaggtgcccagatcccagttatccttgtatccatgtaatttcagatgaattattaagcaaacattttaaagtgaattcattattaaaaactattcatttttttcctttggccataaatgtgtaattgtcattaaaattctaaggtcatttcaactgttttaagctgtatatttctttaattctgcttactatttcatggaaaaaaataaatttctcaattttaa

SEQ ID NO: 6793 - DNA, 547 bp, Homo sapiens
aagtgagacggccgcgggctgaggggccaaggcggcgcggggcgcggtcggtcaggcctgcgccgcccggcggggagcgctcccgccccctgtgggaggctgggatgctgagtcagagcgggggcgggggcgggcgcaccgagaagccccggacgacccgaggccaagccatccaggaccccggctgcgtggacactgcctctgggtataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgttttagaagaaccttctaatg

SEQ ID NO: 6794 - DNA, 513 bp, Homo sapiens
atccccgctccgcgccgcgcggccggtcctcgacctgcatcccgtccggcggctttgggcataaagaggacgactccgttaccgggcctgggccctggctgcctggggaggcaggggcacctctttcccttagactcgctgttttctaccctctttccgagcgtcgacacaacgggcagtttttaaattataacaagaggattgcctgatccagccaagatgcagagcacttctaatcatctgtggcttttatctgatattttaggccaaggagctactgcaaatgtctttcgtggaagacataagaaaactggtgatttatttgctatcaaagtatttaataacataagcttccttcgtccagtggatgttcaaatgagagaatttgaagtgttgaaaaaactcaatcacaaaaatattgtcaaattatttgctattgaagaggagacaacaacaagacataaagtacttattatggaattttgtccatgtgggagtttatacactgtttta

SEQ ID NO: 6795 - DNA, 2555 bp, Homo sapiens
gtgctcggcgcagtccggtgcgattggccacccctggcaggagccgcacctcggacagcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggaccgaaggagatggagcatgccatgctaatccggacgagtccacccgagagctagagtacaggcagctgcacacgttacagaagctacatggatctgatccgtttacagcaccagacggaactggaaaaccagctggagtacaataa

SEQ ID NO: 6796 - DNA, 4384 bp, Homo sapiens
gtgctcggcgcagtccggtgcgattggccacccctggcaggagccgcacctcggacagcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcaca

SEQ ID NO: 6797 - DNA, 4301 bp, Homo sapiens
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggtgagttgtcctcctgttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcctacctacattctcatgcattgattcatagggatattaaagcaggaaatattcttctaacagagccaggtcaggtaaaactagctgattttggatctgcttcaatggcttctcctgccaactccttcgtgggcacaccttactggatggctccagaggtgatcttagctatggatgaaggacagtatgatgggaaagttgatatttggtcacttggcatcacttgtattgaattggcggaacggaagccgccccttttcaacatgaatgcaatgagtgccttatatcacattgcccagaatgactccccaacgttacagtctaatgaatggacagactcctttaggagatttgttgattactgcttgcagaaaatacctcaggaaaggccaacatcagcagaactattaaggcatgactttgttcgacgagaccggccactacgtgtcctcattgacctcatacagaggacaaaagatgcagttcgtgagctagataacctacagtaccgaaaaatgaaaaaaatacttttccaagagacacggaatggacccttgaatgagtcacaggaggatgaggaagacagtgaacatggaaccagcctgaacagggaaatggacagcctgggcagcaaccattccattccaagcatgtccgtgagcacaggcagccagagcagcagtgtgaacagcatgcaggaagtcatggacgagagcagttccgaacttgtcatgatgcacgatgacgaaagcacaatcaattccagctcctccgtcgtgcataagaaagatcatgtattcataagggatgaggcgggccacggcgatcccaggcctgagccgcggcctacccagtcagttcagagccaggccctccactaccggaacagagagcgctttgccacgatcaaatcagcatctttggttacacgacagatccatgagcatgagcaggagaacgagttgcgggaacagatgtcaggttataagcggatgcggcgccagcaccagaagcagctgatcgccctggagaacaagctgaaggctgagatggacgagcaccgcctcaagctacagaaggaggtggagacgcatgccaacaactcgtccatcgagctggagaagctggccaagaagcaagtggctatcatagaaaaggaggcaaaggtagctgcagcagatgagaagaagttccagcaacagatcttggcccagcagaagaaagatttgacaactttcttagaaagtcagaagaagcagtataagatttgtaaggaaaaaataaaagaggaaatgaatgaggaccatagcacacccaagaaagagaagcaagagcggatctccaaacataaagagaacttgcagcacacacaggctgaagaggaagcccaccttctcactcaacagagactgtactacgacaaaaattgtcgtttcttcaagcggaaaataatgatcaagcggcacgaggtggagcagcagaacattcgggaggaactaaataaaaagaggacccagaaggagatggagcatgccatgctaatccggcacgacgagtccacccgagagctagagtacaggcagctgcacacgttacagaagctacgcatggatctgatccgtttacagcaccagacggaactggaaaaccagctggagtacaataagaggcgagaaagagaactgcacagaaagcatgtcatggaacttcggcaacagccaaaaaacttaaaggccatggaaatgcaaattaaaaaacagtttcaggacacttgcaaagtacagaccaaacagtataaagcactcaagaatcaccagttggaagttactccaaagaatgagcacaaaacaatcttaaagacactgaaagatgagcagacaagaaaacttgccattttggcagagcagtatgaacagagtataaatgaaatgatggcctctcaagcgttacggctagatgaggctcaagaagcagaatgccaggccttgaggctacagctccagcaggaaatggagctgctcaacgcctaccagagcaaaatcaagatgcaaacagaggcacaacatgaacgtgagctccagaagctagagcagagagtgtctctgcgcagagcacaccttgagcagaagattgaagaggagctggctgcccttcagaaggaacgcagcgagagaataaagaacctattggaaaggcaagagcgagagattgaaacttttgacatggagagcctcagaatgggatttgggaatttggttacattagattttcctaaggaggactacagatgagattaaattttttgccatttacaaaaaaaaaaaaaaaaaagaaaacagaaaaaaattcagaccctgcaaaaccacattccccattttaacgggcgttgctctcactctctctctctcttactcttactgacatcgtgtcggactagtgcctgtttattcttactccatcaggggcccccttcctccccccgtgtcaactttcagtgctggccaaaacctggccgtctcttctattcacagtacacgtcacagtattgatgtgattcaaaatgtttcagtgaaaactttggagacagttttaacaaaaccaataaaccaacaacaaaaaaagtggatgtatattgctttaagcaatcactcattaccaccaatctgtgaaagtaaagcaaaaaataataataataaatgccaagggggagagagacacaatatccgcagccttacaccttaactagctgctgcattattttattttattttatttttttggtatttattcatcaggaataaaaaaaacaaagttttattaaagattgaaaatttgatacattttacagaaactaattgtgatgtacatatcagtggtgacatattattacttttttggggacggggggtgggtggggtgaagagatcttgtgatttttaagaacctgctggcaagagtttaacttgtcttcagcatattctgattgtatcataatcattttctgctgttgcagaggatgtgaatacacttaaggagctcacagaatcccagtagcacaaattgggctttggcaaatcgtgtattttgtgtatagaaggaatttaaggagaggtattacttattttcatattgtattttaactgtttctctgatcaaatttttttacttcctcctcctgttcctccccacctccctccttttccagttcagtatttggagttcaacactgtctctcaatcagatcatcttgatctttttctttatctcccttccccttcctaagtcccatttcttggtcataaatattgcattattcacactttcaaactgtgtattttcttacaataaaaaatgatgaaaaaaaaaaaggctttacttcttttgcatgcactttaaaaacaaaacaaaacatttttcaggttccaaggaagagcatgataactgtcagagcttttaattatatttgtaaataaaagtgttcatcaca

SEQ ID NO: 6798 - DNA, 597 bp, Homo sapiens
caggctggagtgcaatggctcaatctcggctcaccgcaacctcagcctcccgggttcaagcgattctcctgcctcagcctccctagtagctgggattacaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaagaacacactgcttggttggtgatggaatattgcttaggctcagcctctgatttattagaagttcataaaaaaccacttcaggaagtggagatcgctgccattactcatggagccttgcatggactagcc

SEQ ID NO: 6799 - DNA, 594 bp, Homo sapiens
tttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagaaaccaaggcttaaagggatgaagtaataaaaagctagtagaggccgggcacggtggctcacgcctgtaatcccagcactttgggaggctgaggcagacggatcacgaggtcaagagattgagaccatcccggccaacatggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatga

SEQ ID NO: 6800 - DNA, 881 bp, Homo sapiens
tgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgaggcaacttttaccttgatctcttctgatatgactgaggcctatatccatcctttaaaaaattcttattaatcatgcggaagaagaaatctttccaggagcagcaaactcaggaccggagagataagataaatatataaagcttcagggtatgaagccatacacatagtagaaactgaggcaaaggaaagagttcatgtcccgcctgaaggcagtcaaatcaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagacccatgagaaatggcaagatattcttaaggaagttaaatttttacgacaattgaagcatcctaatactattgagtacaaaggctgttacttgaaa

SEQ ID NO: 6801 - DNA, 590 bp, Homo sapiens
gtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggttgcatcataaatacaaaggactgaagttataaaagagaaaagagaagtttgctgctaaaatgaatctgagcaatatggaatattttgtgccacacacaaaaagcatctggcacaatgtttttgtttggtttggtttggtgttgtaaagagagaggatcttgctatgtttgccagactggtctcaaactcctggtctcaagtcatcctctcaccttggcctcccaaagcattaggattacagacatgagacatcacacccagccccagcacaatgttgaatgtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgagg

SEQ ID NO: 6802 - DNA, 578 bp, Homo sapiens
gttgtaacaggaaatacttcagcttgcaatactgatagtaatgtgtggcacccagatcacgctgtttttatctgcagttcctttttagtattgtacaaagtttcttgaagatttttaaatacataagtttaaaagagaattaactttcaatttgcaaattaaaatgagaatggttgccttttcttcattatcaagagatggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctatagtgggaagcagac

SEQ ID NO: 6803 - DNA, 641 bp, Homo sapiens
agcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcggcggcggcggcgccgggcccgggggtggtgacagcaggtctgaggctggagtgcagtggcatgattttggctgactgcaacctctgcctcccaggttcaagcaattctccggcctcagcctcccgaggagctgggactacaggttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttgga

SEQ ID NO: 6804 - DNA, 613 bp, Homo sapiens
ctctttaagcctcacttaaaaaactaagtgtctgtaataacttcctttctcgggatgaaggtgctgatagcctggggtgttcttataacttaagttcagttttttctttcctgtgaggaagaggcagttttttaaatgaagccatctctggggaaatcgtattgattgttgtagctaaatacggaatttttaaagtctttagtatgttgaactggaaatataggacatgcgtttgagatctactgtgagttgcatcataaatacaaaggactgaagttataaaagagaaaagagaagtttgctgctaaaatgaatctgagcaatatggaatattttgtgccacacacaaaaaggtactgaagatttaccccccaaaaaaaattgtcaatgagaaataaagctaactgatatcaaaaagcagagcctgctctactggccatcatgcgtaaaggggtgctgaaggacccagagattgccgatctattctacaaagatgatcctgaggaactttttattggtttgcatgaaattggacatggaagttttggagcagtttattttgctacaaatgctcacaccagtgaggtggtggcaattaagaagatgtcctata

SEQ ID NO: 6805 - DNA, 1741 bp, Homo sapiens
gtgaaagtgaaagaaaagtcggcagcagagggaacagggaagaaacctaaaggctgcaggctgccaggtgtgcttggagagcccccttcttccgccgggcctcgcaagcagcgtaggactgtggagaagggcggtgggcaaggagggaactcgagagcagcctccatgggcacacaggagggctggtgcctgctgctctgcctggctctatctggagcagcagaaaccaagccccacccagcagaggggcagtggcgggcagtggacgtggtcctagactgcttcctggcgaaggacggtgcgcaccgtggagctctcgccagcagtgaggacagggcaagggcctcccttgtgctgaagcaggtgccagtgctggacgatggctccctggaggacttcaccgatttccaagggggcacactggcccaagatgacccacctattatctttgaggcctcagtggacctggtccagattccccaggccgaggccttgctccatgctgactgcagtgggaaggaggtgacctgtgagatctcccgctactttctccagatgacagagaccactgttaagacagcagcttggttcatggccaacatgcaggtctctggagggggacctagcatctccttggtgatgaagactcccagggtcaccaagaatgaggcgctctggcacccgacgctgaacttgccactgagcccccaggggactgtgcgaactgcagtggagttccaggtgatgacacagacccaatccctgagcttcctgctggggtcctcagcctccttggactgtggcttctccatggcaccgggcttggacctcatcagtgtggagtggcgactgcagcacaagggcaggggtcagttggtgtacagctggaccgcagggcaggggcaggctgtgcggaagggcgctaccctggagcctgcacaactgggcatggccagggatgcctccctcaccctgcccggcctcactatacaggacgaggggacctacatttgccagatcaccacctctctgtaccgagctcagcagatcatccagctcaacatccaagcttcccctaaagtacgactgagcttggcaaacgaagctctgctgcccaccctcatctgcgacattgctggctattaccctctggatgtggtggtgacgtggacccgagaggagctgggtggatccccagcccaagtctctggtgcctccttctccagcctcaggcaaagcgtggcaggcacctacagcatctcctcctctctcaccgcagaacctggctctgcaggtgccacttacacctgccaggtcacacacatctctctggaggagccccttggggccagcacccaggttgtcccaccagagcggagaacagccttgggagtcatctttgccagcagtctcttccttcttgcactgatgttcctggggcttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacccttccccaagcccccacagctactccaacccaaacaacaaccaagccagtttaatggtaggaatttgtattttttgcctttgttcagaatacatgacattggtaaatatgccacatgcctttggtggaagt

SEQ ID NO: 6806 - DNA, 1849 bp, Homo sapiens
cctctggcgctaccatggcgtttggcaagagtcaccgggatccctacgcgacctccgtgggccacctcataggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctgg

SEQ ID NO: 6807 - DNA, 2340 bp, Homo sapiens
cagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactattaaaacaatttaatacttt

SEQ ID NO: 6808 - DNA, 1522 bp, Homo sapiens
ctctggcgctaccatggcgtttggcaagagtcaccgggatccctacgcgacctccgtgggccacctcatagcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcag

SEQ ID NO: 6809 - DNA, 1526 bp, Homo sapiens
ccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatggcttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtcctta

SEQ ID NO: 6810 - DNA, 2500 bp, Homo sapiens
aaaagcccacctgggatccgagcgggcggccgcgccactctcgcaggctccatacacccgccactacccgcctgtaccacctgcagccggcagcgcagcctcctcgcgggtcccgcagggcgcgctgcaggtgcgctgggcgtcccgaagccccgccctcgcgtccctgccccgcgcccagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagttcagactgaagattggggccagttcatgcacatctgtgacataattaacactacccaggatgggccaaaagatgcagtgaaagctttgaagaaaaggatttccaaaaactacaatcataaagaaatccaacttaccttgtcacttattgacatgtgtgtgcagaactgtggtccaagtttccagtctctgattgtgaagaaggaatttgttaaagagaatttagttaagctactgaatcccagatacaacttgccattagacattcagaatagaatcttgaatttcattaagacttggtcacagggcttcccaggaggtgtggatgtaagcgaagtcaaagaagtatacctcgacctggttaagaaaggcgttcagtttcctccctcagaagcagaggctgaaacagcaagacaagagactgctcaaatctcatcaaatcctccaacatctgtccctactgcaccagctctttcttctgtaattgctccaaagaactcgactgttacattggtcccagaacagattggaaaactgcacagtgaattggatatggtgaaaatgaatgtgcgagtgatgtccgccatattgatggagaatactcctgggtctgaaaaccatgaagacatagagcttctgcagaaactctataaaacaggtcgggagatgcaggagaggatcatggacctgcttgtggtggtggagaacgaagatgtaactgttgagctaattcaggtgaatgaggatttgaataatgctatccttggatatgagaggtttactagaaaccaacaaaggattttggagcaaaataagaaccagaaggaagccaccaatactaccagtgagccttctgccccatctcaagatctcctcgacctaagtcccagtccccggatgcctagggccactctgggagaactcaacaccatgaataatcaactttcaggcttaaatttcagccttccaagttctgatgtaacaaacaacttaaaacccagtcttcatccacagatgaacttgctagccttggagaatacagagatacccccgtttgcccaaaggaccagccaaaacctcacctcaagccacgcatatgataattttctggaacattcaaattcagtgtttctacagccagttagtctacaaaccattgcagcagcaccatcaaaccagagtctgccacctttgcccagcaatcatccagcgatgacaaaaagtgatctccagccacctaattactacgaggtaatggagtttgatcccttagctcctgctgtcactacagaagctatttatgaagaaattgatgctcaccagcacaaaggagctcaaaatgatggtgactgagaagaaagtggatgatcagctcactaccacatcaaaggtgccaactctctaaaacgtagactctgtgcagctttgaagcctggaagacaatacctaccaacatgtcaaagccatggtggcacatttctgctataatgaagattaaatagaataacagttccaggataacactgattcctgacaacagcgtgagatttcaacagaacttgtttggaacaaatactcacttaaaacttcagcagaagaaaaattacttagtccttaggccaaccaatttaactgcagtgtcatgtttcacaggccttcctacatttagaaatcgtcacacagctgtgataagagtagattattttactatgaaataattctgaatagatgaaagcataaaatgtgagaaactgaatgtattattcaggaagaatactgagtgccttcatttaactaaagttgaatgtaaaagtcaatttgcacttctttataatcctctggtttagaattataaattgttaaaaccttgataattgtcatttaattatatttcaggtgtcctgaacaggtcactagactctacattgggcagcctttaaatatgattctttgtaatgctaaatagcctttttttctctttttactgcaacttaatatttctatttagaacacagaaaatgaaaatatttagaataagttgtacatttgatgacaaataaatcactatt

SEQ ID NO: 6811 - DNA, 1355 bp, Homo sapiens
ttctcccagctgtctgaaggtgtctgattccattatttgcctgtgatgactttgaaagctaggtaaacctgtaaaatgcaaaagccatcaataagaagcaaattgatgctagagtatctcctccttatttgactgtctcagaactaaatagagaaagcagtgacataaacaaatgtacaccaccttcctgccccatgcctttattgttagtcttcttccccagaggagtcctgatctaattgaagagcgtgaacaacccaacctgtccaaaactttataacttcattattttttaagtaaataattttttattcctaaaatgctagagtctcacctcattatctattttcttcttgcagtgatacaatttcttcttgggattttcacaaatggcatcattgtggtggtgaatggcattgacttgatcaagcacagaaaaatggctccgctggatctccttctttcttgtctggcagtttctagaatttttctgcagttgttcatcttctacgttaatgtgattgttatcttcttcatagaattcatcatgtgttctgcgaattgtgcaattctcttatttataaatgaattggaactttggcttgccacatggctcggcgttttctattgtgccaaggttgccagcgtccgtcacccactcttcatctggttgaagatgaggatatccaagctggtcccatggatgatcctggggtctctgctatatgtatctatgatttgtgttttccatagcaaatatgcagggtttatggtcccatacttcctaaggaaatttttctcccaaaatgccacaattcaaaaagaagatacactggctatacagattttctcttttgttgctgagttctcagtgccattgcttatcttcctttttgctgttttgctcttgattttctctctggggaggcacacccggcaaatgagaaacacagtggccggcagcagggttcctggcaggggtgcacccatcagcgcgttgctgtctatcctgtccttcctgatcctctacttctcccactgcatgataaaagtttttctctcttctctaaagtttcacatcagaaggttcatctttctgttcttcatccttgtgattggtatatacccttctggacactctctcatcttaattttaggaaatcctaaattgaaacaaaatgcaaaaaagttcctcctccacagtaagtgctgtcagtgagagagaagttggatcagttcaaagaacccatgattcaatgatttacccatgcctgccacacttccctcagccagacaaagcagcctgttcataaatatacaacatgtccccttcaggcctgtttatccagcctgag

SEQ ID NO: 6812 - DNA, 1042 bp, Homo sapiens
cacttccgtcgagcagccaatatatgcctcattctgcagcaggtaatctaagatagatgtaacagaagcaatattaagaattagcagatatgctacgtgtagtggaaggcatcttcatttttgttgtagttagtgagtcagtgtttggggttttggggaatggatttattggacttgtaaactgcattgactgtgccaagaataagttatctacgattggctttattctcaccggcttagctatttcaagaatttttctgatatggataataattacagatggatttatacagatattctctccaaatatatatgcctccggtaacctaattgaatatattagttacttttgggtaattggtaatcaatcaagtatgtggtttgccaccagcctcagcatcttctatttcctgaagatagcaaatttttccaactacatatttctctggttgaagagcagaacaaatatggttcttcccttcatgatagtattcttacttatttcatcgttacttaattttgcatacattgcgaagattcttaatgattataaaacgaagaatgacacagtctgggatctcaacatgtataaaagtgaatactttattaaacagattttgctaaatctgggagtcattttcttctttacactatccctaattacatgtatttttttaatcatttccctttggagacacaacaggcagatgcaatcgaatgtgacaggattgagagactccaacacagaagctcatgtgaaggcaatgaaagttttgatatctttcatcatcctctttatcttgtattttataggcatggccatagaaatatcatgttttactgtgcgagaaaacaaactgctgcttatgtttggaatgacaaccacagccatctatccctggggtcactcatttatcttaattctaggaaacagcaagctaaagcaagcctctttgagggtactgcagcaattgaagtgctgtgagaaaaggaaaaatctcagagtcacatagacaccttgggaagagatggatgttccacg

SEQ ID NO: 6813 - DNA, 1637 bp, Homo sapiens
tctgcccatggtgaagacataaatatcttagctagggctcagcagagaaattgaagaaaaataaagatatcaccagaacagttatgtgaagatcgatcagcaaactttagagatttctgctttgacgttgagccaacaatgaaagaaggagcagaaaaaggagaaggaagaagaactccactggacactcaaggatgtgaatagcattttagatcagtgaataaccagcagtgacattagacattgaactttctctgttctgacatggaaagtgccctgccgagtatcttcactcttgtaataattgcagaattcataattgggaatttgagcaatggatttatagtactgatcaactgcattgactgggtcagtaaaagagagctgtcctcagtcgataaactcctcattatcttggcaatctccagaattgggctgatctgggaaatattagtaagttggtttttagctctgcattatctagccatatttgtgtctggaacaggattaagaattatgatttttagctggatagtttctaatcacttcaatctctggcttgctacaatcttcagcatcttttatttgctcaaaatagcgagtttctctagccctgcttttctctatttgaagtggagagtaaacaaagtgattctgatgatactgctaggaaccttggtcttcttatttttaaatctgatacaaataaacatgcatataaaagactggctggaccgatatgaaagaaacacaacttggaatttcagtatgagtgactttgaaacattttcagtgtcggtcaaattcactatgactatgttcagtctaacaccatttactgtggccttcatctcttttctcctgttaattttctccctgcagaaacatctccagaaaatgcaactcaattacaaaggacacagagaccccaggaccaaggtccatacaaatgccttgaaaattgtgatctcattccttttattctatgctagtttctttctatgtgttctcatatcatggatttctgagctgtatcagaacacagtgatctacatgctttgtgagacgattggagtcttctctccttcaagccactcctttcttctgattctaggaaacgctaagttaagacaggcctttcttttggtggcagctaaggtatgggctaaacgatgagaaactcacaatttcataagccattcagaccacagattattgaatattgcagacagaaacaggagtctacaaggagtttaaaagatattttatgcttcccctggtttcttttattgtgaaggtcactgtaaatgttttaaattcttctctataatagcatcttacctaagaatattatgtatttatgacatgtatttctacattattaggaatttgaaacttatttgaggaaattattggcagattctattgtaaattaaaaacatatactacagcatacttagatgttaattgtaaatctacaatcttttgtttggcaatggctcttcaattctaaatcattcattgagatgggtgatttaggtaattattttattatctcaagtactcctatttaaatggtgagctacagataattagaacagttatttggaatagaattagggaagtttggacttgcc

SEQ ID NO: 6814 - DNA, 1858 bp, Homo sapiens
tgcattaagaagtcttcagcagtgatattagacattggggcatgctcttacaggcaatgggtggtgtcataaagagcatatttacattcgttttaattgtggaatttataattggaaatttaggaaatagtttcatagcactggtgaactgtattgactgggtcaagggaagaaagatctcttcggttgatcggatcctcactgctttggcaatctctcgaattagcctggtttggttaatattcggaagctggtgtgtgtctgtgtttttcccagctttatttgccactgaaaaaatgttcagaatgcttactaatatctggacagtgatcaatcattttagtgtctggttagctacaggcctcggtactttttattttctcaagatagccaatttttctaactctatttttctctacctaaagtggagggttaaaaaggtggttttggtgctgcttcttgtgacttcggtcttcttgtttttaaatattgcactgataaacatccatataaatgccagtatcaatggatacagaagaaacaagacttgcagttctgattcaagtaactttacacgattttccagtcttattgtattaaccagcactgtgttcattttcataccctttactttgtccctggcaatgtttcttctcctcatcttctccatgtggaaacatcgcaagaagatgcagcacactgtcaaaatatccggagacgccagcaccaaagcccacagaggagttaaaagtgtgatcactttcttcctactctatgccattttctctctgtcttttttcatatcagtttggacctctgaaaggttggaggaaaatctaattattctttcccaggtgatgggaatggcttatccttcatgtcactcatgtgttctgattcttggaaacaagaagctgagacaggcctctctgtcagtgctactgtggctgaggtacatgttcaaagatggggagccctcaggtcacaaagaatttagagaatcatcttgaatatattagaaaaaaaatagctcctaagaaattcttgtatgttatataaatttatacttccttaagattctttcattgtgtataactttgtgaattttacaaagatatgcttggaatcaacaccatccaaacatatcacaaattaggatatatgaaagtatgtatattaccatacagagaagaatgcgaatactataaagagttcttatacaaacagataatatagattttgtatcaatcattcaccttttttgagatttttaaatgagaaaacctataatgtataaaatacatgtgtgtatgtatgtatgtgacacagttactaaaaataggcttcttaaacttacatctcaatctggtagataaagtacataaaagaatatggaattttagtacctatattaagtgtttttaatttttgtataatatttagtacctgattagcgtgtatgcaaaaaagtaatttgcttcgtttgttgaattagaagccagctgccttactaaactaccacatttgctttgctcattctcttggctttgcagatagaaaattatatcatctgcatatagtgacttataatgattattttacttctccattttactacttgtaattcttttttggtatcagttgtataatgaaatggtttgaacattcaaagtgttaagtaatcctgatcgtaactgctgtctttgcaaatggagtgttttctagtgttttaacaataaacgtaatactgactctagctttgagataaattcttttaaaaatattcttcagggagaatatttgtttcctatcttcctgtgtatagtattgtaataaaatctctgttaaaaactatcaa

SEQ ID NO: 6815 - DNA, 1017 bp, Homo sapiens
atgctagggagatgttttcctccagacaccaaagagaagcaacagctcagaatgactaaactctgcgatcctgcagaaagtgaattgtcgccatttctcatcaccttaattttagcagttttacttgctgaatacctcattggtatcattgcaaatggtttcatcatggctatacatgcagctgaatgggttcaaaataaggcagtttccacaagtggcaggatcctggttttcctgagtgtatccagaatagctctccaaagcctcatgatgttagaaattaccatcagctcaacctccctaagtttttattctgaagacgctgtatattatgcattcaaaataagttttatattcttaaatttttgtagcctgtggtttgctgcctggctcagtttcttctactttgtgaagattgccaatttctcctacccccttttcctcaaactgaggtggagaattactggattgataccctggcttctgtggctgtccgtgtttatttccttcagtcacagcatgttctgcatcaacatctgcactgtgtattgtaacaattctttccctatccactcctccaactccactaagaaaacatacttgtctgagatcaatgtggtcggtctggcttttttctttaacctggggattgtgactcctctgatcatgttcatcctgacagccaccctgctgatcctctctctcaagagacacaccctacacatgggaagcaatgccacagggtccaacgaccccagcatggaggctcacatgggggccatcaaagctatcagctactttctcattctctacattttcaatgcagttgctctgtttatctacctgtccaacatgtttgacatcaacagtctgtggaataatttgtgccagatcatcatggctgcctaccctgccagccactcaattctactgattcaagataaccctgggctgagaagagcctggaagcggcttcagcttcgacttcatctttacccaaaagagtggactctgtga

SEQ ID NO: 6816 - DNA, 1096 bp, Homo sapiens
gcaggtgtggatgtcaaactccatcaggtcaactagaaactaattgcatatttaaacatggcagataaagtgcagactactttattgttcttagcagttggagagttttcagtggggatcttagggaatgcattcattggattggtaaactgcatggactgggtcaagaagaggaaaattgcctccattgatttaatcctcacaagtctggccatatccagaatttgtctattgtgcgtaatactattagattgttttatattggtgctatatccagatgtctatgccactggtaaagaaatgagaatcattgacttcttctggacactaaccaatcatttaagtatctggtttgcaacctgcctcagcatttactatttcttcaagataggtaatttctttcacccacttttcctctggatgaagtggagaattgacagggtgatttcctggattctactggggtgcgtggttctctctgtgtttattagccttccagccactgagaatttgaacgctgatttcaggttttgtgtgaaggcaaagaggaaaacaaacttaacttggagttgcagagtaaataaaactcaacatgcttctaccaagttatttctcaacctggcaacgctgctccccttttgtgtgtgcctaatgtcctttttcctcttgatcctctccctgcggagacatatcaggcgaatgcagctcagtgccacagggtgcagagaccccagcacagaagcccatgtgagagccctgaaagctgtcatttccttccttctcctctttattgcctactatttgtcctttctcattgccacctccagctactttatgccagagacggaattagctgtgatttttggtgagtccatagctctaatctacccctcaagtcattcatttatcctaatactggggaacaataaattaagacatgcatctctaaaggtgatttggaaagtaatgtctattctaaaaggaagaaaattccaacaacataaacaaatctgaagagaaactatgcttttctaggacaaacaaagataagatgtttctaaattaacttcagttcttgcattaatgttttatgtga

SEQ ID NO: 6817 - DNA, 1243 bp, Homo sapiens
ctttgaatttgcatgggagcaatttcagccaaacatttcaggtatcactcactaaaggataataattataatttttccaggctataaataactagtcaagctgctcattagttggtttcatcttcaggagtgtagagacaatcctatttcagaggagagctgaacacttccggaagaataacaacgtcgaaataacagcagatgaaaacattattgcatgattcgaagaattgatctatcatgctttaacaggtcacctgtaaattagctcatctacagtgatatttgaaatcagattgttctctctacaaacatgttcagtcctgcagataacatctttataatcctaataactggagaattcatactaggaatattggggaatggatacattgcactagtcaactggattgactggattaagaagaaaaagatttccacagttgactacatccttaccaatttagttatcgccagaatttgtttgatcagtgtaatggttgtaaatggcattgtaatagtactgaacccagatgtttatacaaaaaataaacaacagatagtcatttttaccttctggacatttgccaactacttaaatatgtggattaccacctgccttaatgtcttctattttctgaagatagccagttcctctcatccactttttctctggctgaagtggaaaattgatatggtggtgcactggatcctgctgggatgctttgccatttccttgttggtcagccttatagcagcaatagtactgagttgtgattataggtttcatgcaattgccaaacataaaagaaacattactgaaatgttccatgtgagtaaaataccatactttgaacccttgactctctttaacctgtttgcaattgtcccatttattgtgtcactgatatcatttttccttttagtaagatctttatggagacataccaagcaaataaaactctatgctaccggcagtagagaccccagcacagaagttcatgtgagagccattaaaactatgacttcatttatcttcttttttttcctatactatatttcttctattttgatgacctttagctatcttatgacaaaatacaagttagctgtggagtttggagagattgcagcaattctctaccccttgggtcactcacttattttaattgttttaaataataaactgaggcagacatttgtcagaatgctgacatgtagaaaaattgcctgcatgatatga

SEQ ID NO: 6818 - DNA, 1075 bp, Homo sapiens
gtctaagaggcagacagatacattgttcttcactggtcagctgaaagtcaattcatcatcagtgatattcaaaaatcacaagtctttgctggcatgccaagtgcaatagaggcaatatatattattttaattgctggtgaattgaccatagggatttggggaaatggattcattgtactagttaactgcattgactggctcaaaagaagagatatttccttgattgacatcatcctgatcagcttggccatctccagaatctgtctgctgtgtgtaatatcattagatggcttctttatgctgctctttccaggtacatatggcaatagcgtgctagtaagcattgtgaatgttgtctggacatttgccaataattcaagtctctggtttacttcttgcctcagtatcttctatttactcaagatagccaatatatcgcacccatttttcttctggctgaagctaaagatcaacaaggtcatgcttgcgattcttctggggtcctttcttatctctttaattattagtgttccaaagaatgatgatatgtggtatcaccttttcaaagtcagtcatgaagaaaacattacttggaaattcaaagtgagtaaaattccaggtactttcaaacagttaaccctgaacctgggggtgatggttccctttatcctttgcctgatctcatttttcttgttacttttctccctagttagacacaccaagcagattcgactgcatgctacagggttcagagaccccagtacagaggcccacatgagggccataaaggcagtgatcatctttctgctcctcctcatcgtgtactacccagtctttcttgttatgacctctagcgctctgattcctcagggaaaattagtgttgatgattggtgacatagtaactgtcattttcccatcaagccattcattcattctaattatgggaaatagcaagttgagggaagcttttctgaagatgttaagatttgtgaagtgtttccttagaagaagaaagccttttgttccatagagacccctaaagagtatcctgactacaaggatgaaagaaatca

SEQ ID NO: 6819 - DNA, 5119 bp, Homo sapiens
ctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaa

SEQ ID NO: 6820 - DNA, 5173 bp, Homo sapiens
cgtctcgcgggcctcggcccggtgcgagcggctccgcgatgtggctgagcccggaggaggtgctggtggccaatgcgctgtgggtgacggagcgggccaaccccttcttcgtgctgcagcgacgccggggccacggcaggggcggcggccttacgggtcttctcgtgggcaccctggacgtggtgctggactccagtgcccgcgtggccccttaccgcatcctgcaccagacccaggactcccaggtctactggacagtggcgtgtggttcttcccgcaaagagatcacaaaacactgggaatggctggaaaataacttgctccagacactgtccatcttcgacagtgaggaagatatcaccaccttcgtcaagggcaagatacacggaatcatcgcagaagagaacaagaacctgcagccccagggagacgaggaccccgggaagttcaaggaggctgagctgaagatgcggaagcagtttgggatgcctgagggcgagaagctggtgaattactactcctgcagctactggaagggccgcgtgccccggcagggctggctgtacctgacggtcaaccacctgtgcttctactccttcctgctggggaaggaagtgagcctcgtggtgcagtgggtggacataacgcgtctggagaagaacgccaccctgctcttccccgagagcatccgtgtggacacccgcgaccaggagctcttcttctccatgttcctcaacatcggcgagaccttcaagctcatggagcagttggccaacctggccatgcggcagctgctggacagcgagggcttcctggaggacaaggccctgcctaggcccatccggccacacaggaacatctcagccctgaagcgagacctggacgcccgagccaagaatgagtgctaccgagccacgttccggctgcccagggatgagcggctagacggccacacaagctgcaccctgtggacgccgttcaacaagctgcacatccctggccagatgttcatctccaacaactacatctgcttcgccagcaaggaggaggacgcttgccacctcatcatacccctgagggaggtgaccattgtcgaaaaagctgacagctccagcgtgctgcccagccccctgtccatcagcaccaaaagcaaaatgacattcctgtttgccaacctgaaagaccgtgatttcttggtgcagaggatctctgacttcctccagaaaacaccatccaagcagccaggcagtatcgggagcaggaaagccagtgttgtggaccctagcacagagtcttccccagctcctcaggaggggtcggagcagcccgccagcccagcctctcccctcagcagccgccagagcttctgtgcgcaggaggcgccaaccgcatcccagggcctgctgaagctcttccagaaaaactcgcccatggaggaccttggagccaagggggccaaggagaagatgaaagaggagtcatggcacatccacttcttcgagtacgggcgtggcgtgtgcatgtaccgcacagccaagacgcgggcactggtcctgaagggtatccctgagagcctccggggagagctgtggctcctcttctccggggcctggaatgagatggtgactcaccccgggtactatgctgagctggtggagaagtccaccgggaagtacagcctggccacagaggagatcgagcgagacctgcaccgctccatgcccgagcaccctgccttccagaacgagctggggattgctgccctccggcgggtgctgactgcctatgccttccgaaaccccaccatcggctactgccaggcaatgaacatcgtgacctcggtgctcctgctctatggcagtgaggaggaggccttctggctcctggtggccctgtgcgagcgcatgctgcccgactactacaacaccagggtggtgggagccctggtggaccaaggcatcttcgaagagctcacgagagacttcctgccgcagctctcggagaagatgcaggacctgggggtgatctccagcatctcgctgtcctggttcctgaccctcttcctcagcgtcatgcccttcgagagcgccgtggtcatcgtcgactgctttttctatgagggcatcaaggtgatcctgcaggtggccctggccgtcctggacgccaacatggagcagctgctgggctgcagcgacgagggcgaggccatgaccatgctgggcagatacctggataatgtggtcaacaagcagagtgtctctcctcctatcccgcacctccgtgccttgctgagcagcagcgatgacccccctgcagaggtggacatctttgagctcctgaaagtgtcctatgagaaattcagcagcctgagggccgaagacattgagcagatgcggtttaaacagaggctgaaagtgatccagtccttggaggacacggccaagaggagtgtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagcatctcctctggcctcagatctggatcttttcctgccctgggaggctcaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgtaatgaaa

SEQ ID NO: 6821 - DNA, 2748 bp, Homo sapiens
cgcccatcctgggaaggggcccggagtgtgagagagagactcccccacgcccatcctggaaaggagcccggagtgtgagctgagtggtccgagctatacctgtggacattggtttctccattgaagagctggaggacctttacatggtgtttaaggccaagcacctggctagccagtactgggggtgcagccgcacaatggccggccgtcgggaccccagcctgccctacctggagcagtaccggattgatgccagccagttccgggaactctttgccagcctgacaccctgggcctgtggctcccacacacctctgctggcagggcgcatgttcaggctcctggacgaaaacaaggactcgctgatcaacttcaaggagttcgtgacagggatgagcgggatgtaccacggggacctgacagagaagctcaaggtgctctacaagctacaccttcccccagctctgagcccagaggaagccgagtcagccctggaggcggcccattatttcacagaggacagctcctcagaagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaataaaaaccactgtgtgcaatgccttgctgtggcccccaaccactgcttaggcctcccaacttctccccaggccaagtatggggccctggctgtgttctggaagttcaagacacttagtcctccacagtgggtggaagagtgcaaggtctgccaggtcagatggagacgcagaacctgctggtgcaagctgggcaggtcctgaccaacctgcatcaggggatgccctgagctccacaggtcttcatgggcaggggttgtgggtcctggtgaaggaagtgcatcctcaggcctgggctgtagcaagctgtctgcccttgggttcaagaaccagactgtggagccaaaggtgaccgcagggggccccagggctggagccacaaggataccctcactttgcatgaggagctgaaactgaccagtgtccagtgttagcccccacatggggctgctcttgcttctactaaaagatacagcagttacccccttatccacaggggatacagtggatatctaaaaccagacccccagtggatgtctaaaaccacagataataacaaaccttatacatactgttttttcctatgcatacatacctgtgattaagtttatgaattaggcaccttaagagattgacaacaataactaataataaaatgtaacggttatactgt

SEQ ID NO: 6822 - DNA, 2912 bp, Homo sapiens
aagccactcctctgcaccgcctccgtgtctgctgtaggtgggcggtaaataaggcccccacactaggcgccaagcaggcccagggcaaggcctccacagccacatgttagagacattctgtcttcctgtgagtaggaaacaaatacaaaatgctgtcattggagcgtgtgaaagacacagtgtggctgagtgggggctggaaagaatagtggatgctttcctaggaaaaatcttcatgttccacgtcacgttttttgttaaggaaaaacacgcatgttgagtgcctgttagaactcatccctgtgctatgtttaaagcctgttgggagcatctgatcccaggtgatgggagcatgctaggccctgggctttcgcagtcgagctggtttcacatgggggataatgcacaccaaggaaccgactcaaaagagaaccaaaaatagtgtgtaccaagatgcccatggcagtcctggtgacagtggcagaggctgacttgagcttgaggaccttgatttcaaggacagaaactacagaagcaggtacaccttctgttgtacatggaaccagcaggccactctaggcttgtcccgcatgcttctgggagcggcatgttggtgcagagccctggcctcagaccgcatgtggcccccaggaagcagggcctccattccagggtgagttgcctgagcccagagaggtgtgcccttcactgccaccagacagccagcgagagcagctcagaactggggtgctgccgacctgcctgaggtgcccccaccagccacactgcctttggggaacagctccaggagagctggtcggctgcttctctccccaggtgcatgttcccacgcagggagtatagtgcgcgccagttccggcaaatgtcctccccgaaacgctgcaccaagcacaggagctgtgcacagaccacccctcagtaacaggcacagcaggcgcgggtggaaggggtcattagggttcccctgagttctagcaggaacattccccagagttctagcaggaactatagaattcgttagtcctcagactggtctatagccctcatcattgttcacgtcaaaaccagcatgttgagacttgtattcatttgaaaaaaggaattgagggtttggcggcctttattttaacctgaccaagtgagggaatgctcaggcccttttgctctggtgccatagggcggggctgggcgggccaggcaggaggtgtggcatgggagacctgctccccagggcctggcctggggctggctgtacagaaacacagactacatctcaaggaccccaggagcttgcagtcccaacagcagaatgttattcatgttctttttatttttgcgtttgtccagaagcactaccacaggaagagcaagaaggaagtggaagtgaggagagaggagaggagaaggggaccagctctccggactatcggcactaccttcgaatgtgggccaaggagaaagaggctcagaaggagacgattaaggatcttcccaagatgaaccaggagcagttcattgagctgtgcaagacgctttacaacatgttcagtgaagaccccatggagcaggacctgtaccacgccatcgccaccgtggccagcctcctgctccgcatcggagaggtggggaagaagttctcagcccgcacaggcaggaagcccagggactgtgccactgaggaggacgagccaccagcacccgaactgcatcaggacgcagccagggagcttcagcccccagctgcaggagacccccaagccaaagcaggcggagacacacacctcggaaaagccccacaggagagccaggtggtggtggaggggggcagcggcgagggacagggctcaccctcccagctgctgtctgacgatgaaaccaaagacgacatgtccatgtcctcctactcggtggtcagcacgggctccctgcaatgtgaagaccttgcagacgacacggtgctggtgggcggggaggcctgcagccccacagcgcgcatcggcggcaccgtcgacaccgactggtgcatctcctttgagcagatcctggcctccatcctgacggagtccgtgctggtgaacttctttgagaagagagtggacattggactcaagatcaaggaccaaaagaaagtggagagacagttcagcaccgccagtgaccatgagcagcctggagtttccggctgatgcctgcagctgtgaggcctggcccaaggtgtcatcagtggggctggcctcatctcctcctgcctttcctcccttatcagtttctctttaaaggtgtgcccctcctgctctcccaggagcagtgagttgtgagtggaaagaaggctggtgcagacccagctgccttagacagattccctgggcctgcatctcctggcgccggctgcttctgggcccaggaagaggctgtggctcccaccttccttacacctggtgggagcccgcctcgcaccagctgcacctgcctagcattacaggctctcagatctgcccttgcttgcctcatacctctgtgctccacactgcggccaggccagctgagtccctccatccgtggatgctttcctgcagctatgtggtatgggggtcattcctgcctcttggcaccaggttggggggcatgtgcttgttgggcaccaaagtgatggaaccctcaggtgctctccgggagcctgaacctcctgactgaggaacatgggcagaacatgtttattgcacagagtgggcgctgcgcacaggcgtggctgtacacgtgctctcagctcatcatcctttccagtaactttaaaaaaacatccctcaggtcctgatatatttccttggattcatttcacttggctagaaattacactgtgctcaatgccttaataaatccctgaaagaaat

SEQ ID NO: 6823 - DNA, 1369 bp, Homo sapiens
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagagtccaaagtttgggatctcccatcaacatcccacgtgtcaatgtggaaaacgagtgattctgtgtcttctcctcagcctggagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtagatttccttgtttcataaaaaagactcacttattccatggatgtcattgatccaggcttgctttagtttcatgaatgaagggtactttagagaccacaacttctctgtc

SEQ ID NO: 6824 - DNA, 1145 bp, Homo sapiens
tcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggaggcgctcatccgcactgatggaatgagggtgacctcaagaaagtcagcaaaatatagacttcaggggactatcccgagaggtgatgtctccttgaccatcttaaaccccagtgaaagtgacagcggtgtgtactgctgccgcatagaagtgcctggctggttcaacgatgtaaagataaacgtgcgcctgaatctacagagagcctcaacaaccacgcacagaacagcaaccaccaccacacgcagaacaacaacaacaagccccaccaccacccgacaaatgacaacaaccccagctgcacttccaacaacagtcgtgaccacacccgatctcacaaccggaacaccactccagatgacaaccattgccgtcttcacaacagcaaacacgtgcctttcactaaccccaagcacccttccggaggaagccacaggtcttctgactcccgagccttctaaggaagggcccatcctcactgcagaatcagaaactgtcctccccagtgattcctggagtagtgttgagtctacttctgctgacactgtcctgctgacatccaaagcatctgatacagcagttcctgagcagaacaaaacaacaaaaacaggacagatggatggaatacccatgtcaatgaagaatgaaatgcccatctcccaactactgatgatcatcgccccctccttgggatttgtgctcttcgcattgtttgtggcgtttctcctgagagggaaactcatggaaacctattgttcgcagaaacacacaaggctagactacattggagatagtaaaaatgtcctcaatgacgtgcagcatggaagggaagacgaagacggcctttttaccctctaacaacgcagtagcatgttagattgaggatgggggcatgacactccagtgtcaaaataagtcttagtaga

SEQ ID NO: 6825 - DNA, 4354 bp, Homo sapiens
cgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcggcaggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctgct

SEQ ID NO: 6826 - DNA, 590 bp, Homo sapiens
acaggctagcgaagttgcctggtgcaggtgacgcccccattccagcctttggactggagccataggagaagcggatcgcgggatcctggttgttttcgagaatcacgcagcaaggggcctgcctatccctctccctgggaccctgatgtcgcttttgaacagcccctgcacctggcagccagcgagctactgtagtaggcattgccgactgtttgcataccggatgggagtgacagtgtaatagaaaaacaagcaagaaaccttttaggttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctc

SEQ ID NO: 6827 - DNA, 6564 bp, Homo sapiens
aatgggcacggggcctgatgccgcttccggcccaccctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttaggtaggactcctaaggctcagaggaagttacctccagccgctgccatgcccaactcagtgctgtgggcggtggacctcttcgggagagtgtacacgctgtccacagcaggccagtactgggaaatgtgcaaggactcccagctggagttcaagcgcgtcagcgccaccacgcagtgctgctggggcattgcctgtgacaaccaggtctacgtgtatgtgtgtgccagcgatgtccccatccgccgccgagaggaggcctatgagaatcagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcaggggtctgcccacggaccggtacatgtggagcgatgcctcggggctgcaggagtgcacgaaggctggcacgaagcccccgtccctgcagtgggcctgggtttccgactggttcgtggatttcagcgttccggggggcacggaccaggaggggtggcagtatgccagcgacttccctgcctcataccatgggtccaaaacgatgaaggattttgtgaggaggaggtgctgggccagaaaatgcaagctggtgaccagtgggccctggctggaggtgccccccatcgccctcagggacgtgtccatcatcccggagagcccgggtgccgaggggagtgggcacagcatcgccctctgggccgtcagcgacaagggggatgtgctgtgccgcctgggcgtgtcggagctcaaccctgcgggctcctcctggctgcacgttggcaccgaccagcccttcgcctccatctccatcggggcctgctaccaggtgtgggccgtggcaagggacggctccgccttctaccggggatccgtgtacccctcgcagccagccggtgactgctggtaccacatcccgtccccaccgagacagaggctgaagcaggtgtccgcggggcagacgtcggtgtatgccctggatgagaatggaaacctgtggtatcgccaagggatcacgcccagctacccgcagggctccagctgggagcacgtgtccaacaacgtgtgccgagtgtccgtggggcccctggaccaggtctgggtgatcgccaacaaagtgcagggcagccacagcctgagccgggggacagtgtgtcatcgcaccggcgtgcagcctcacgagcccaagggccacggctgggactacggcatcgggggaggctgggaccatatctctgtccgggccaatgccaccagggccccccggagctcgtcccaggagcaggagccgagtgccccaccagaggcccatggccccgtctgctgctgaggcccccccacacacctacatgcagggacggtgcccagtttgggggatcaaggctgagccattcttgtgctggagtgtgcaccgtgggagcaatgtggcccaggtggactcaggagggaacctggccccaaggctgcggccacttcagaggcactggctgagacggccctgaaatgtgaagctccgcggacactcccacacgtgtccccgtctgcgaggagtcccggggtgtggggcatggggtggggctgcacctcccagaggcccctcccacccttcccttcccctctcccttctgcctttccaggactagaaccgggaacctggagccctccgggaacgccggccctggggcagcagagccaggatggagccctcctgagctggcatctcagacagcacccgggcccgccacccctcaccaagagagatggccatggggctcagggcctctttaccatgtgcagtgaccatttctcagagcaggacttgcaaagaggctttaatttcaaaagtgaaggaaggaggccaggcgccgtggctcacgcctgtaatcccagcactttgggaggctgaggtgggcagatcacctaggtcaagagtttcaaaccagacgggccaacatggtgaaaccccatctctgctaaaaatacaaaaaaaaaaaaattagctgggcatggtggtgggtgcctgtaatcccagctactcgggaggctgaggcaggagaatcgtttgaacccgggaggcggaggctgcagtgagccgagatcatgccactgcactccagcctgggcgacagagactccatctcaaaaaaaaaaaaaaaaaaaagtgaaggaaggagacagcagattggaaataacactggagtggatgggatgtcctcttccctgagggggccggggtaccagacgggaggctgggagaggatgagaggctgccccatggctggaggcagtgtccgtgtgtgcagtcaccatcatcaacccccattcggccccttccccagatgcgctggtgacaggggcttcttggatgtcaaatcatgttgtaggagggtgcagactgcgggcttctgtggggagcagtactactgtgtctgtcggcagtggccatgggaccctcagcccgtcctgtacatggagcagggtgcacagtcaccctccatcctgtggcgagaggctggcccggcccggccaggcgaggcagaaggtgtcggccaagtggccccgaccccatcccgcagtctctcagctgctttttattacctctgtgccccatttgggagtttgcttcctccacctggacactttgcccgggaggtcatcagagcccaaccccaggctctgctcggttggagaggggatgacttcaccaccacctgaccttcctagggtcctggtctcactgtcagctgggggtccgttgtgtgtatttgtacagttttgctgtatggggtttgtcacccaaaagctgatgctgagaaaggcctccctggggcccctcccgcgggcatctgagagacctggtgttccagtgtttctggaaatgggtcccagtgccgccggctgtgaagctctcagatcaatcacgggaagggcctggcggtggtggccacctggaaccaccctgtcctgtctgtttacatttcactatcaggttttctctgggcattacgatttgttcccctacaacagtgacctgtgcattctgctgtggcctgctgtgtctgcaggtggctctcagcgaggtacggggagggcgtcaccctgcagaacggcagagtgacgcgtcctctcgctgctgagcaccagctgtttacctgccctgcatcacttcctcggatactttactcaataagcatttcccctggagtgtccgtgccctggtgttttttatcgatacgttgattaaaacgcgtggttccccgtgtgcctgaagcagacattgctgtgaaatcttttatttttgttttatgacacagcatcaatttcatgaatactttgaaagggccattagaaaaaataagagccaatttgggtcatttgagaaacattttcagcacaattacagtgggggcacgggccgttcggctccagctgggttttcccagatgcaacaatcgcggttctggcttctccactggtggggatggggatcgcgccttcggagctctcagggcgcctgtctgtcgggggctgggtgcgtccacagccccgggggatggcgcgtggcgtagcccaggaacggcatgtgggtgggtctctgacctgcttgtgcagggacttgagggacctcatcccgatggccgaggcaggggctccccacgggataaaaggatccggcctggccttggggtccaagaggagggccaagggagtggacctggcccctgtcccctctcctcctcgaaacactggacaccctgaagcgagactatggctgctgaggatcctgtgtgatgtggccgcggggcgtcccctctggcctcaggggaagaaggactgggcggctcggcccaggtcaccctctaggaagcagaggaggtgcaggtgccagttcagggcagaaagaaagagccactgaggccattgtcctgaaggcggtgacccccaggcactcctgctgccccccaggaagccctgggctgcgctggacaccgggccgagtctccgtcttctggaccgaggctcttctgggctttcaggctcagctcgtcggtccattcagcaagttcaggggcagactgagccctgctctggccat

SEQ ID NO: 6828 - DNA, 2716 bp, Homo sapiens
accctcttgcccggtccccgggagggccggtccgctcctcccggacgccgaggacctaccaccgcgacttcgccccgcccggcgcgggcccaggaccctgatgtcgcttttgaacagcccctgcacctggcagccagcgagctactgtagtaggcattgccgactgtttgcataccggatgggagtgacagtgtaatagaaaaacaagcaagaaaccttttagcgctggaatcccatgggcggcttctgtgagaagctcctgctgagtgaccgctgggggtggagtgacgtgagtgggctccagcaccggccgctggacagggtggcactgccctcgccgcactgggagtgggagtctgactggtacgtggatgagaattttggaggtgaacccactgagaaaggggggtggacgtacgccatcgactttcccgccacctacacgaaagacaagaagtggaattcttgtgtgcggcgccggaagtggatccggtacaggagatacaagtcccgggacatctgggccaagatcccctcgaaggatgaccccaaggagctgcccgaccccttcaacgacctctctgtagggggctgggagatcacggaggagcctgtgggccgcctgtcagtgtgggctgtgtctctgcagggcaaggtgctgtgtccctgtcttgcctcccaggtgtggtacagagaggacgtcagccactccaaccccgaagggtcctcctggtccctgctggacacccccggggaggtggttcagatcagctgtgggccccacgacctcctgtgggccacactctgggagggacaggccctggtccgggaaggaatcaacaggagcaatcccaaaggaagttcctggtccatcgtggagcctcctggatctgaaaacggggtcatgcacatctcggtgggagtcagcgtggtctgggctgtcaccaaggactggaaggtgtggttccgaagaggcgtcaactctcacaatccctgcggcaccagttggattgagatggttggtgagatgacgatggtgaacgtgggaatgaacgaccaggtgtggggcattggctgtgaggaccgagccgtgtacttccggcagggtgtcacccccagcgagctcagtgggaagacctggaaagccatcatcgcggcccgagagtgtgaccggtcacactctggcagctcgtctagtctcctcagtgccggctgcttcttcggtgatgaggtgaggggtagtggcgagtctgcccccagcgacaccgatgcctcctcggaagtcgagagaccagggcctggccagattctccctgcagaacctctagacgattccaagaatgccacagggaactcagcctcaggcctgggggctggcaggaccgcagaagataccgtggaagatgcctgcccagccgagggcagcagggaggccagacccaacacgcaccccggcccggcccccaccccggccgagctgccctggaccaatattgacctcaaggaggccaagaaagtgcccagccactcggccgctggcttccccgagaccaccagcctctcctctctggggctcctcccactgggcttggaggagccgtatggggtggatgaccacccgctgtgggcctgggtgtcgggaggcggctgcgtggtggaggcatgtgccatgcccagatggttcactgtccaggcgggcctgtcctcctcggtacacatgctgtccctgtccatcacgccggcccagaccgctgcctggaggaagcagatcttccagcagctcacggaaaggaccaagcgggagctggagaacttcagacactacgagcaggccgtggagcagtcggtgtgggtgaagaccggggcgctgcagtggtggtgcgactggaagccccacaagtgggtggacgtgcgcttggccctggagcagttcacggggcacgacggcgtccgggacagcatcctcttcatctactatgtggtccacgaggagaagaagtacatccacatattcctgaatgaggtggtggcgctggtcccagtgctgaacgagaccaagcactcctttgccctgtacacccctgagcggacacggcagaggtggccggtgcgtctggctgctgccaccgagcaggacatgaatgactggctcgccctgctcagcctgtcttgctgcgagagccggaaggtgcagggccgcccgtccccgcaggccatctggtccatcacctgcaagggggacatcttcgtgagcgagcccagcccagacctggaggcccacgagcaccccctgccctgcgaccagatgttttggcggcagatgggaggccacctgcggatggtggaggccaacagccggggcgtggtgtggggcatcggctatgaccacacggcctgggtatacacaggcggctatggaggcggctgcttccaaggcctggccagcagcaccagtaacatctacacgcagtcagacgtgaagtgtgttcacatctatgagaaccagcgctggaaccccgtcacaggctacaccagcagtagagacaggatttcaccatgttggtgaggctggtctccaactcctgaactcccgaagcccgcctcagcctcccaaagtgttgagattacaggcatcatcaggcgagagccactgcgcccggcctccacttctgccttttccaaattgacgaaataaacacttagtaatagaaacaac

SEQ ID NO: 6829 - DNA, 1509 bp, Homo sapiens
tggttgcctagcaaccggtggtgccaaacactggagctcagagcggggggcgcggagagcgaagcgggaaaggaggtggtgtctgtgaacaggcctaggggtttctgacccttctggtttctgtgccatggccacgctgagcgtcaagccaagtcggcgcttccagctgcccgactggcacactaacagctacctgctatccaccaatgcccagctgcagcgagatgcttcccatcagatccgccaggaggcccgggtgctccgcaacgagaccaacaaccagaccatttgggatgaacatgacaacaggactcgactggtggagaggattgatactgtcaaccggtggaaggagatgctggacaagtgtctgacagatttagatgccgagatcgatgccctgacacagatgaaggagtcagcagagcaaaacctgcaggccaagaacctgcctctggatgtggccattgagtgcctgaccctgcgggaaagccggcgagacattgatgtggtgaaggaccctgtggaggatgagctgcataaagaggtggaggtcatcgaggccaccaagaaggccttgcaacagaaggtcagccaggccttcgagcagctctgcctcttgcaggaagtccaacagcagctcaactccgaccatcggggcaaaatggagacactagagatcgacagaggctgtctctctctcaacctcagatccccaaacatctcgctgaaggttgaccccacacgtgtacctgatggctccaccacactccagcagtgggatgacttcagtcggttcaacaaggaccgagcggaggctgagatgaaggcagccacagagctgagggaggccactgctctaactattgctgagaccaacaacgagcttgaagcccagagagttgcaacggaatttgccttcaggaagcggctgcgggagatggagaaagtgtacagtgagctcaagtggcaagagaagaataccttggaggagatcgctgagctgcaggaggacatccggcacctggaggaggatctgcgcacaaagctcctgagcctgaagctgtcccatacccggctagaggccagaacctaccggcccaacgtggaactctgccgggaccaggcacagtacggcctcaccgacgaggttcaccagctagaggcaaccatcgctgccctgaagcagaagctggcgcaagcacaggacgcactggacgccctgtgcaagcacctggcccggctgcaggctgacattgcctgcaaggccaactccatgctgctggacaccaagtgcatggacacacggcgcaagctgaccgtgcctgctgagaggttcgtgcctgaggtggacaccttcacacgtaccacaaatagcaccctgagtccactcaaaagctgccagctggagctggcctagccttggaggactgcaggaggagggcagggttgggtgggcaatggaaggagggaggagagaaatgaatggaataaatgcagaggatctca

SEQ ID NO: 6830 - DNA, 3074 bp, Homo sapiens
gatttccgggcggcggaaggagacgcggccgcgtgaggacgaggctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaa

SEQ ID NO: 6831 - DNA, 824 bp, Homo sapiens
cacctttcaaacatattaagtgaagtgactgctgtgtttacagataaagatgctaatgtacgattagcagcagttcaacttcttcaattcctggcccccaaaatacgagctgaacaaatttctccattttttcctttggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttt

SEQ ID NO: 6832 - DNA, 2622 bp, Homo sapiens
gctatttgaaaacacgctccgggagctagagcctgaggtcggcggcgcacgctgttgccccgtgggcttctgctccctcgcttgtcttctcgggcttctcgccccggccgcggccgggtcctcagtagtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaattcctggcccccaaaatacgagctgaacaaatttctccattttttcctttggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagagggacaagctgtggggggtctgtgtctccatcctggctctcttgcctcgagtcctcaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctg

SEQ ID NO: 6833 - DNA, 3006 bp, Homo sapiens
tttgcggagcttcaggtgactgggcgggttcgcctggtttcgggtccgagagagttttagcccggagtgtgtgaatcgggccccacttccccgactctggtcctggccggcgtcccttggagtaggaggaacgatggtttcctaaaacccatgtcgagaatgactaaaaaaagaaaacgccaacatgattttcaaaaagtaaaattgaaagttggtaaaaagaagcccaagttacaaaatgctactcctacaaactttaaaacaaagactatacatctgcctgagcaactcaaagaggatggaacacttccaacaaacaatagaaaacttaacataaaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagagaggacacagagactcttattaaggcagtttatacattatatcagcagaggggccttatccttccagttcggactttgttattgaagtttttcagtaaaatctatcagacagaagaactgagatcttgtagattcagatatcgtagtaaagtgttatcccgttggctggctggcttaccattgcaacttgctcatcttggctcccgaaatcctgagctctctacacagcttatcgatatcattcataccgctgcagcacgagcaaataaagaattactaaaaagtttacaagctactgccctccgaatttatgatccacaagaaggtgctgtggtggttctccctgcagactctcagcagcgtttggttcagcttgtatatttcctacccagtctgccggctgatttgctttctcggttaagtcgttgctgtattatgggaagactcagttcaagtttggctgccatgcttatcgggatactgcacatgagatcatcattttctgggtggaagtattcagctaaagactggttgatgagtgatgtagactatttcagcttcttattttccacacttacagggttttcgaaagaggagttgacttggcttcagagccttcgaggagttcctcatgtcatccagacacagctttcccctgtgcttctctaccttacagatttggatcaatttttacaccactgggatgtaacagaggcagtttttcacagtttattggttattcctgcccgaagtcagaactttgacatcttgcaaagtgccatcagtaagcatttggttgggttgactgtaattcctgacagcacggctggctgtgtttttggtgttatctgtaagctcctggatcatacttgtgtagttagtgagactctactgccatttctggcttcttgttgctacagtcttctttattttctgctcactatagagaaaggggaagcagaacatctaagaaagaggttgatgctgcagagcctgcgggtgaacagagttgggcctgaggagctgcctgttgtgggccagctgcttcgactgctgcttcagcatgcacccctcaggactcatatgttgaccaatgcgatcttggtgcagcagatcatcaagaatatcacgacattgaagagtggaagtgttcaggaacagtggctcacagacttacattactgcttcaacgtgtatatcactgggcatccccaagggcccagtgcactggctacagtgtattgaagaggccatagtacctcctgtttgaagttgtttattcacatctatcttatttgaagaaaaagactgatgtaatagatctttgtcattaaagctgaacttttaaagaagtttacg

SEQ ID NO: 6834 - DNA, 1788 bp, Homo sapiens
acgctccgggagctagagcctgaggtcggcggcgcacgctgttgccccgtgggcttctgctccctcgcttgtcttctcgggcttctcgccccggccgcggccgggtcctcaggatttgctgtcacagatgcatcactacaatgctggggttaaacaaagtgctcttcttggacttaaagaccttttgtctcaatacccatttataattgatgcacacctttcaaacatattaagtgaagtgactgctgtgtttacagataaagatgctaatgtacgattagcagcagttcaacttcttcaattcctggcccccaaaatacgagctgaacaaatttctccattttttcctttggtaagtgcccatctctctagtgccatgactcacattactgaaggaattcaggaggactctttaaaagttttggacattctgctggaacagtacccagctctaattactggccgtagcagcatattgcttaagaattttgtagaacttatttctcatcagcagctgtccaaaggactgataaatagagacagatcccagtcctggatactttctgtaaatcctaatcggagactcacttctcagcaatggaggctgaaagtcttagtgagactcagtaaattccttcaggccttggcagatggatccagtaggttgagagaaagtgaaggacttcaggaacagaaagaaaatccccatgccactagcaactccatttttatcaactggaaggaacatgccaacgaccagcaacacatccaggtttatgaaaatgggggttcacagccaaatgtcagttcacagttcaggctacggtatctggttggaggactgagtggtgtggatgaaggcctgtcatctactgaaaacctgaaaggatttattgagataataattccattgctaattgaatgctgggttgaagctgtacctccacaactagctactcctgttgggaatggtatagaacgagaacctctacaggttatgcagcaagttcttaatattatttcccttctgtggaaactctctaaacaacaggatgaaacccataaattggagtcatggcttcgaaagaactaccttattgattttaaacaccattttatgagtcgttttccatatgtcttaaaagaaataaccaagcacaaaaggaaagagccaaataaaagcatcaagcattgcacagttctctccaataacatagatcatctcttactgaatttaacactgtctgatatcatggtctccctggcaaatgcgtcaactttgcagaaggattgcagttggatagaaatgataaggaaatttgtaacagagacccttgaagatggctctaggctaaatagtaagcaactgaacagattgctgggagtatcctggaggttaatgcaaatacagccaaacagaggtaggtgatgctactttgcccttatttaagagtggagctcttacatgtgctatcttaaggtctagctttgaaatgatggcttgtaaacattccatgtagtcaggctaattgtattcaagccataaaaggtagctactgtctacttgaacactgaaattgtttatggctcagagtatctctaagtgggtaggtccactctgaagcagattgataaagatttctaccctcttctgatctagtttggctagaacttgagaactttttcccttgattgatatggcatgaatcttccctgtctctttaccttttttctagcttaaggttaagttatattaagtcagttttagagtgacttactaattctttg

SEQ ID NO: 6835 - DNA, 5089 bp, Homo sapiens
gtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgccattcacttctcggcatccggcgaggaggaggaggaagaggaggaggagttcagggagtactttgaggaggggctggatgaccaaagcattgtaacagggctggaagccaaggaagacctctatcttgaaccccaagttggccatgaccccgccggccctgctgcctcgcctgtcctggcagatggactgtccgtgtcccaggcccctgccattttgcccgtctccaagaacactgtaaagctgttggagtcccctgttccagcagcacaagtattaagtacagtgccattggctgtgtccccagggtcgtcttcgtcggggcccttagctagctctcccagtgtgtcatccctttctgagcagaaaaccagttcttcctccccattgtcctctccttctaagtctcccatcctctcatccagtgcctcaacctccaccctttccagtgcaaaacccttcatgagccttgtgaagtccctgtcgaccgaggtggagccaaaagaatccccacaccccgcaaggcacaggcacttgatgaagacattagtcaagtctctgtccacggacacttcccggcaggagtcggatacagtgtcctataagccacctgattccaaactgaacttacacctgttcaagcagttcacacagccccgaaacacaggtggagattccaaaactgcaccttcttccccactgacttctccctctgatactcgttccttttttaaagtgcccgaaatggaggctaaaattgaagatactaaacgacgcctttcagaagtcatctatgagccttttcagctccttagtaaaattataggggaagaaagtggcagccataggcccaaagccttatcttcaagtgcttcagaactctccaatctgtccagcttgaatgggcacttggaaagcaataacaactacagcatcaaggaggaggagtgtgattctgagggggatggctacggaagtgattccaacatccccagaagtgaccacccaaagtccactggtgagcccacaagagagatagaactgaaaagttcccaggggagcagtctgaaggatttaggcctgaagacaagttctctagttctggagaaatgttctttgtctgccttagtgagcaaagaagatgaagagttttgtgaactgtacactgaggacttcgatttggaaacggagggggagagtaaagttgataagctctcagatattcctctcaagccagaggtgctcgcggaagatggtgtggtccttgacagtgaggacgaggtggactcggccgtgcagcacccggaattgccagtgaagacgttgggcttctttataatgtgtgtctatgtgtacctcatcctccccctcccccactatgtgagtggactctttctgggaattggccttggattcatgactgcagtttgcgtgatttggttttttacaccaccaagtgctcataaatatcacaagttacacaaaaatctgcgacactggaacacaagatctctggatatcaaagaacctgaaatactgaagggatggatgaatgagatttacaactatgatccagaaacctaccatgcgactttgacacattcagtctttgttcgacttgagggtggaaccttaagactttcaaagcccaataaaaatatatccaggagggccagctacaatgaacccaagccagaggtcacctacatcagccagaaaatctatgacctctcagacagcaagatttatcttgtacctaaaactttggctcgaaagcgaatctggaataaaaagtaccccatttgtatcgagcttggtcagcaagatgactttatgtctaaagctcagactgataaggagacttcagaagagaagccgccagctgagggaagtgaggaccctaagaagccaccccgccctcaggagggaacaagatctagccagcgagatcagatactctatctctttgggagaactggccgagaaaaagaggaatggtttaggagatttattctggcatctaagctaaagtcggaaatcaagaagtcatcgggtgtctctggaggtaaaccagcccccgtcttcttggctccagggcttttgcctgcacacagcagacacaacagtccgtccgggcacctgacccacagccgcagcagcagcaaaggcagtgtggaggagatcatgtcacagccaaagcagaaggagctggcaggcagcgtgcggcagaagatgcttctcgactacagcgtgtacatgggcaggtgtgtcccccaggaaagccgaagcccccagaggagccccctgcagagtgcggagagcagccccacagctgggaagaagttgccagaggttccaccctctgaggaggaagaacaggaagcctgggtgaatgccttgcttggaagaatattttgggacttcttaggagagaaatactggtctgatctggtgtctaagaagatccaaatgaaactcagcaaaataaagctcccctactttatgaatgagctcactctgacggaacttgacatgggcgtggctgtgccaaaaatcctccaggccttcaagccttacgttgatcaccaaggactctggattgatttggaaatgtcctacaatgggtcctttctgatgactctcgagaccaaaatgaatttgaccaaactaggtaaagagcctcttgttgaagccctgaaggttggagaaattggcaaagaaggttgcaggccccgggcattctgtctggcggacagcgatgaggaatcctccagcgctggctcctccgaggaagacgatgccccagagcccagcgggggagacaaacagctcctcccaggggctgaagggtacgttggaggtcatcgaacaagtaagattatgaggtttgttgataaaattaccaagtcaaaatatttccaaaaagcaacagagacagagtttattaaaaagaagatcgaagaagtctccaacacacccctgctgctcactgttgaagtacaagaatgtagaggaaccttggcggtcaacattccaccacccccgactgaccgagtatggtatggtttccgaaagccaccacatgtggagctgaaagctcggccaaaacttggagagagagaagtgactttagttcatgtgacagactggatagagaagaaactggagcaagagtttcagaaagtttttgtcatgccaaacatggatgatgtttatatcactataatgcactcagccatggaccctcgctctacttcctgcctcctgaaagacccacctgtggaggctgctgatcagccatgatgggtgatgtcagatgttccccatattgtgacatcgagctggatgtgtggggttcttggccgccatctgtactgtagcactggcctctgtgccacagctactgtttcttaaaggactgcttctgccctctgcctgccagtgcccattccactgtgaggtgtcattccctgcatctagtgacaactgtctggattgcctgctgcaaagctttgatttggcaaaggagaccatggaagaatcatggtggatccagaagttatacgtgacccacaccatggcttttaaaagtctacccatgtttgtggcagcaaatgagcacagtaagagcaaagctgaacaacttgcctcctctactcctccaaagcttttcttcaggcagccggtgcacagtggactttttcacttctatactttgtatgcggccttccacacttccagagaatgtcagtgtgcaatgtgtctggagggtggggagaggaattctgtgagccttttcatttcggtgacagaagagatgggcagagcaacttattttccacattaaattgtgcatttgggaagcaagtagccatagtacacacacaacacgctatcagcttgggtaaggacagtgggatttatgtgaacatcaggcaaagccatgagatcaaaccatcccaagcctttcaccaatgaggtacaaccacctgggggctagctaatcttgaatgttttcctgagacaggagcgtatgtgaaaacatcaaacactgcacatgacaggatgggtcctctcatacagatgggatggggttagaaagccagagccagtttttccatctggcgtttcctgtgtcctccaggtttatatgggaatcgaaacagtttgttaatctgattgggagagttccatgggcagatttcccttcctgaaggccaaaacggagaactgctctctttaattatttcaagagtcaagaccaaaagtttgctcagcatcacactacatctcaaaattaatgttgccaacttaattttgtgcatttgtgtcagaatgtttagtttacaaggttgggggctctctttgcttcgagaagtaaacctaataccatttttttattgtttaaagctgcattcaacgtcaaaattaccttgggtaacttttgataacttacatgtgtggacaaagctaatagtggttttttaaacagcaccttgcctgaacatgactttaaagaaattaatatattgaaaacatgtttgaacccttattttaattgcaccattaaaacatttgacttaaattgtttgaccattccagttggtgtactgttctgatttttcgttgtgtaggccgatctgcctgtcagagtccacgtgtcctggtcactggtctttataattgttgtgcaataactaaaggctaaggactagatgcactatcgtgtaaagagattacacatgactgtaccatgttgcacttaatcaaatagtatgtggggatttaaaatcgcttgcattgtttcacaaaataaatatctcaatgtcaaatact

SEQ ID NO: 6836 - DNA, 3441 bp, Homo sapiens
gcggcgctagcgcgagcctggccccgggcagcgctagggccgggctcctctcggcggcggcgcaccgtcgtcctgtcgtccgcggggcggggacgcggcggcggcggcggcggtggcggctgtgtgtcgccggagccgaagcgcgcaggcccgtcccggtggccggggagcgggcgggtgggggcgccatgtggttcatgtacctgctgagctggctgtcgctcttcatccaggtggccttcatcacgctggctgtcgcggctggactctattacctggcagaactgatagaagaatacacagtggccaccagcaggatcataaaatacatgatctggttctccaccgctgtactgattggcctctacgtctttgagcgcttccccaccagcatgattggagtgggcctattcaccaacctcgtctactttggcctcctccagaccttccccttcatcatgctgacctcgcctaacttcatcctgtcgtgtggactagtggtggtgaatcattacctagcatttcagttttttgcagaagaatattatcccttctcagaggtcctggcctatttcactttctgcctgtggataattccgtttgcgttttttgtgtcactttcggccggggagaacgtcctgccctctaccatgcagccaggagatgatgtcgtctccaattatttcaccaaaggcaagcggggcaaacgcttagggatcctggttgtcttctccttcatcaaagaggccattctacccagtcgtcagaagatatactgacccccatgcaggcaggatgtggggggcaagatcaggagagtcaggcccctgggcctctatgccaggtggggaccagaagtcgggaaggcacctaccacctgccctggctttcttcccctcaactctggagccccatccccaccctccttggggggctcagcttggctcagatctgatgcttcaagaggctgtaacctcagagggcaccaaggagggtggcagagcctgcttagccaggaggccgaggtccctcagtcctcccctgtcccttccaaggtgggtcaggaggttctggccccgctggggcaggcagggcagggtctgtgaagcttaagagcagatggtgacaagttctctgggcaggtggccatggggaggggccatggcttggcatgtccaacagaaatagtttttgctgttgaacggtgatttctgtccaagtgcagatttccgtttgaataaagcttcgcttctaggtggcactgtttgccttaataccctgacagttcatcttcctttcttcctgctaaccttctgctctggactggactcacttttctgctccagggactccttttctgggtttgggtcttgcccttcccaagggactgttcttgtggcccttaatgggaagggggcaggggtgaggagctgagcctgctcaaggagtgggaagtggggctataggcagcctctctgatgcactctcttccatctctttccccaaggctccgtgactgtcaaactgggagtaggagaggggacaatttaggactgggctagattttcagaagaacatctacaatatcctatttataaatcttcctctgggaaaaggagtggtttctggctgaatactatcttaggctcaaggagaaacaaaataaaaattagcttccaggcagcctgtttttaaagaaatgggactaatgggagaagctgtttgtcactctaagagcatccaagccctggcccgtctgtgcactcttggctcctggggagatatatctgccttctaagaaggcaggccaggtcttgggcacagacctgcatttgttgaccttgcactccaactatagtgccttgcaagtgctcaacagtacatattggaatgaagtccctatgagagccatttctggccatgttctatacctcaaagtgaggctggcaggtacagagatgaactgtacacatgtgatacatttaagccactggaaaaacccctgtgcttgaaaatatttcctctatatcatgcctggagttccatcatagcccttcatttccttggctttagcatttaccttctcttaagaataccagctttcccctttccctgagaggaagagcacatgttggtctcctcttagtgtgaacgagattgccaggcccttttctcctatgcacaccaggatagacaaggcaggggatactggcagcctgcatcatcctcccattgggctgacagctggccctactttcctccctctgctgcttggtccctcaccttgatgatgtggcttcgccccctccactctactgccagtgttctcccagggcttgctaaatccagcagacccctttcctgtcttactagatctgggcagcatttgacatggctgatcaccccttgcttcttggatggcacttccctggcacctctgtggctagttgtcctacctccctggctgttcctttcaggcttccgtgcaggcttctccacttgcccatgcacagtagggtctttcagggttctgctgtgggctccctagggaagcccatccatctggatggtttcaaggatggtgaggaatttagagttgacctccagccccaacatccttcctgatcacctgaaccacagttttgctgccctctaggtgcacagacaattcaggtccatggcccagatggtacttgctgtcttctgcaaacctgccccttctgggtacttcccttgaccccgagatcactcaggagccagacaggaaacttattctattcctgttttctctttctgcccaccacatccaatctctcaaaacggtcaggtctaccttaacatctcttgatttgagccactcccactgtcatcagctttcacctggattatcgtgacagcctcctactgcttctctatcatgtggccagagctatcttcctaaaatgcattgcatagttgatcaagtcactctctggcctaaaaccttccttggctccctgctgccctcaggataaagtctggacccctcagcatggcttgtgagactcatggtgtccttgtccctgctcacctctctggtctcatcacttgccttcttgcattctgggtcccagcctcctgtatccagagatgcagtggctctccattgccactctgattcctcctttcttttggtcacagagaaagggtactttctctgtcaaatctcaacttagacttgacttcctccaaggagctttggctatactctctcctcccgacccccaccctggcatactacacagatcactctgggctcacttgcctgcctaatggtcatctccccagtagactgtaagctccttgagggcaaggattgtgttggaatttttgtattaacagtgcctggcttggtgcctggcacctagaaagcactcaataaatgtttgtttaatgaatgaa

SEQ ID NO: 6837 - DNA, 1471 bp, Homo sapiens
ttattctctcagtgtatcgaagatatcagtcaactatcttctggattgcattgatgctattgagaaggcagcctgcagtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcaca

SEQ ID NO: 6838 - DNA, 1471 bp, Homo sapiens
ttattctctcagtgtatcgaagatatcagtcaactatcttctggattgcattgatgctattgagaaggcagcctgccgtctaaaagtcatggttttaaaggcggaacacaccaggagccccagcgcaaccctcccctccaatgtgccttcatgccggtccctgtcatccagcgaagacggccccagtggcccttccagcctcgcagatggaggcctagcccacaacttacaggatagtgtcaggcaccgcatcctctacctctcagagcagctgagagtggagaaggccagtcgggatggcaacactgtgagctacctcaagctggtatccaaagcagaccggcaccaggtgccgcacatccagcaggcctttgagaaggtgaaccagcgcgcctctgccaccatcgcccagatcgagcacaggctccaccagtgtcaccagcagctccaggagctggaggaaggctgcaggcccgagggcttactgctgatggcagaaagcgacccagccaactgcgagccacccagtgagaaggccctgctttcagagccccccgagccaggtggggaagacgggccggtcaacctgcctcatgccagcaggcccttcatcttggagagtcgcttccagagcttacagcaggggacgtgcttagagacagaggatgtggcccagcaacaaaacctgctgttgcagaaggtaaaggcagagctggaagaagccaagaggttccacatcagcctccaggagtcctatcacagcctaaaggagaggtctctgactgacctgcagctgttgctggagtcccttcaggaggagaagtgtaggcaagcattgatggaagaacaggtgaatggtcgcctgcagggacagctgaatgagatttacaacctcaaacacaatctggcctgcagcgaagagagaatggcctatctatcctatgagagagccaaggaaatatgggagatcacggagaccttcaagagccgaatatccaagctggagatgctacagcaagtcacccaactggaggcagcggagcacctccaaagccgtcccccgcagatgttgttcaagttcctgagtccgcgcctctcactggcaaccgtcctcttggtctttgtctccaccttgtgtgcctgcccctcgtcactgatcagctcacgcctgtgcacctgcaccatgctgatgctgatcgggcttggggtcctggcctggcagaggtggcgcgccatccctgccacagactggcaggaatgggtcccctccaggtgtagactgtactccaaggactctgggcctccagcagatggaccttaaggggccaggagggccacctgccttagcttgctagctccctccctcctcctgggtgctgagggcatccagcaagcccctccacagctcttgcttgccgattatgtaaccaccagcctggtgaaatggatatagacgcccacctgcctcaca

SEQ ID NO: 6839 - DNA, 1613 bp, Homo sapiens
agtcaggaccagcccagcagcccagccacagaggagccagcgaacctctcccggcgcctgtgctgggggctttctgttccagcgtcaaggatggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactttaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttca

SEQ ID NO: 6840 - DNA, 1871 bp, Homo sapiens
ccagcagcccagccacagaggagccagcgaacctctcccggcgcctgtgctgggggctttctgttccagcgtcaaggatggaggagggggagaggagccccttactgtcccaggaaactgcaggccagaagcccctctctgtgcacaggccacccacctcaggctgcctaggtccagtgcccagggaggaccaggcggaggcctggggctgcagctgctgtcccccggagaccaagcaccaggccttgagtggcacccccaagaaaggaccagccccttccctctccccagggagcagctgcgtcaagtatctgatcttcctctccaacttccccttctccctgctggggctgctggccctggccatcgggctctggggcctggctgtcaaggggtctctgggaagtgatctgggggggcccctgcccgcagaccccatgctggggctggcactgggagggctggtggtcagcgcagtgagcctggctggctacctgggcgccctctgtgagaacacctgcctgttacgtggcttctctgggggcatccttgccttcctggtgcttgaggccgtggcgggggccctggtggtggccctctggggcccgctgcaagacagcctggagcacaccctgcgtgtggccatcgcccactaccaggacgacccagacctgcgcttcctcctcgaccaagtccagctcgggctgaggtgctgcggagctgcctcctaccaggactggcagcagaacctgtactgcctctcaagcccttgctcttcccagtaagacctgtggaccattccagaagcctctgccagagttccatccaccctcccctgctccaactctaccttctcaatgagctcagcagcctctgcggagggaggtcctcttatcaatgcttgtctgttcccccttcaaccgtctcactaaatatcctcctgctagtcaacacagccaccacccctacctgcaagcgcagaggactgccgtgcacagggatacgttatagagagccaggtactttaactaactgcagctcccccggggtgcaggcctgcagccttcccgcctcctgctgcatcgacccccgcgaagatggagcctctgtcaacgaccagtgcggcttcggggtcctgcgcctggatgcggacgcagctcagagagtggtgtacctggagggctgcggcccgccgctccggcggtggctgcgcgcgaacctggctgcctcgggcggctacgcaatcgcggtggtgctgctgcagggcgcggagctcctgctggccgcccggctactcggggccctcgctgcccgcaggggggcggcgtacggccccggagcgcgcggggaggaccgcgctggcccccagagccccagccccggcgccccgcccgctgccaagcccgcccggggctgagcgcacgccccgaggtccgagaccgccacgcacagggatacagggggcgcctccgcccggctaaaaagcgcggcctgcgccgccgccgccgcctgatttcgctcgggcttcgggtgacttcgccgcaggacctacccagctcgctcacttcgctcgctccgcgtcccccatgccagcccccaacgcagggcgcccggcgaagccacgggactggcgggaggagcacgcggggccggaggaaatcctgaagctgaccctcacctccgagcccccactcccaccccagccgcacagttcccacctcctggcacctccctcccctggggccgccaccccttctgggctcgtgatggtggagctaaggtccaggcctctccctcccgagtgcatttttggggagatagtaaatgttttattcgggtgtatcattcatacagtaaagacaccaatcttc

SEQ ID NO: 6841 - DNA, 5505 bp, Homo sapiens
agtggaggaggcaggaatgcctgggacactcgcggggcatgtgagcaggcccagaagccatggcccactataagactgagcaggacgactggctgatcatctacttgaagtatttactctttgtcttcaacttcttcttctgggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctgagcccccatggccagatcctgggcagggaaatgatcctttcaggagacaaccagagcccctcaccaggaacgggggcacccgtggactacgggagggtggcggttgggttctctgctccctcccagctcctgaacctggaacaatcggcagaaaacccaggaaccccggcactcctgcattcagcacgggattcccccacccatgcccagaagccctgaccttgctgtttctggaaaaagcatggggtggggcagggagggctggcatttcccccagaagaccttgccctttgacctgcccactctccacactgcctcacctggaaagccatgtcctgctggcctcattccttcctgaagggcctaggagtggggaggcctgggtagggcagccacaggctgggtagagccgccctggcaggaagcagggggtaaggtggccataccagcacatgctgcactaggagcagagccctgcacctgcctagctgccttcctgggagaaacctccctgggagaccatggccccaagccctggcctctagtgatacgcccctcgggaatctcctgttccggggcctgattctcaggaacaccaggtttcagaccatcttcagcacctaatgttgatgggtgtcaaacatctcctggagtggaccaactcgcaaccctgcaaagtcggagctgctgagaaggggcagctctgaatagaggggcatctgcctgaacctcacttttcctggggccctctccttgaccccgtagccaccaccacactgcttccagggggtccagctctgcttcccttcccacctgtcctagagtggacagagctttttccttgggttctctcttgcatcactaagttcagcagggaatttgcggaattttcaggaagaactttccccagtaataagggagaacagaaagaaaatcctagaaaatacagagtatccatgctggcagctttttgtacaacacccatagggacccccccaaatggctattacaaaggggcagcccattcactacacaagaaccccacacctggcttccaccctccccagctcctgcacttctccccagagcgggaccctcttacttccccccatgaaggggggcaccttgtgctaaggccaaggctgagcgaggtcccagctcacctccctgcttgatccagattgcactgtgatgagcacattgctgacctaggccagtcctggggcaggcgtgctctctctcccatacataggagtggcctcaaggccacccagtgctgaccccaacagagccctgaactgtccagaaactgcatcctcagcacaggaagtacccacatggacagagggaagcccagcctcggggccggttgcctcctcttctctgggtgttctccagtggcttcttggagcctaggctggtttatctcccctgcctaaaaggccctggggttgccaatgcaaattcattaaaacgaagaccagatatcccagactgcacagaggccgagagaaatggtatagtgcgtgattagcattgctgccctccaacctcctgggattcatgcagataatcaaaaactgactatgactcccaagttctctgaaggatgagatcacaactgacaactcttacgacagagggagagtggtgagagagagaaagagggtactgggctagagccatgttcttcctgccgaggtgccagggggaggcggcagtgggcagggggtgctggggccttacctgtctgccctggtggggatgaaagacaggtgacaggcaggtgccctgtgcacagccttatcattgaaggcaggcccaggacagcctgccccatctgccccagccccatgggatggttggtccagcctgactggggcaggattagctgcaattcctgccctgtgtgtcgtccagccagactgcctcttgaaagatggcttgtccaagcggcagacagtggtagaacaacccagggcttggaaatctgacctccttgtccatgccaacagcctgggagatgagacagggttagaggaaacagaggcccaggatacggcaggttctgcctgggagtgtacaatggttggagtccagagccaacgatgtggtccccagcggggtgtgcccctcctgctgacgagggtacagatccatacccaggtcaattcctcccgggcccctgtttggaggctgctacagccttgagttccttggagagagaggacacgcctgtggaatgtcaccttcagtcccgtgcaggcaaaaggcccctgcacaccagggccctaggaaagcagcatcaggtgctgggatcccacccagctggcacgggcacgttcttgccctgcacactccatgctgcccttccctgagctcgcaggggcagacaccaagagaagggcgcgtccccgagtcccctgggtgacctgtgtcaggacagcaggcaagaatgaaacgtggccttggctgacgggttggaatatttgtgaccgttcttgtctttctccctcctgcttccccggcaccctagccccatctccaggagcccctcaggcagagtaagtggggagtgtgtccagggatttttttgtgtttaccaaggtcctgctgtgcacttagaatctgtcaccataaatacttatctcgcagttaccccagcaagagggtgttatttcccccattttataaaaggaaattaaggctgggcaaagttaagacttgcttgtcagtggtcatggctgttgtcttgccacccccagctggggagaaggaagaaaactgggccgggaacccctcccctcagtgtcccccagttctccatctccataaggagccatcaggctgtcattaaggaacagagtgtcactcagggggcactgtcacaaagcagcacccatggcacatgggccgggggtgcagaagcctggcttatttcaggctgacagctggaccctctgggtgcaggggctcaggcagtggccaagagcccaaagggctaaggcccgtgacgaccacccagcccgtcaccccaggtacaaacactgaccccaaagcaagagcagggactgtccctcagccctcagggccttcatgcagggtgcagaatctcatgtccacatggaggtcacccctcaggtcacacccactcccagagcaaccctgggcagggaggggcaccctggggttgtgttgaccacctccccttcaggtgaggcccttttctgccttctttctagccccctgcatggggcacctgctattgctggggctctggggtggaccctgtgtgatttctgtcagggagcttgtgctgtgcatggccagaggtgtttacatccagaagggcccagcacggccctgtggggtgtggggggaatatggtagatcattgtgatgtgcctcggggccctcttgccttggagccagctttgtttcagaatctgctacttgggccctcttcagggttttgaggctggagaagtgagttgggacagtcactgtcatcaccacccaccctgtcacccacctggaaaacattcttgatatactggccatgctgggccgggctcacatccactgagggtatagtgaccaagcgtctaaaccagtcgttctcaaacttcggtgagtatcagaatcacctggaagggcttttacaaacagattgctggccccaccccccagaatttctcatcaggagtgggcaagaccaatcatttgcatttctgacaagttcccaggagctgcagctgctggccctggaaccacactttgagaaccactgctttagaccaaacaccaaaggaagatgcagccaccctcctttacatgtcacaacgctcagggtccatgagtacctcaggctgtccagctgagctccacctgcagcagccgagattcccgactcgctccaccattgggggctaggagtgaagcgtgtcaccatggtcagctcatggccagccaggaaagcctctctgctgtgcgtctgtgcagttcttgttcttccctggaggactcttggatcgcctgtgatcttggccaggagaccaggtgcctgggtcccttcctggaaggggacaagttacacaccccagccccattttcccaccaacttctacatgccttgggagaacctgctacatgttggctgcccccttcccctatttcagcagtgcccagtcctgcttataaacctgaggcctgctccccataccctgccctgtgcaagtgccagccgttattccaggcagcccaatgttgttgaggccagatggattcctggaagcagctggcccatggatgtgagtcatcacagtattctagaaacagagaagaggtcttaacctaatgcgcatagagaaattgttctcattgtaaacatacccctgtccttagctgatctaggtggaagcccagcttcatgtgctagggggcatgataatgataataaaggaattgtatctagga

SEQ ID NO: 6842 - DNA, 988 bp, Homo sapiens
agactgtcccgagcttcccccgggcgggcagagggaagccggctggggatgaggagtggaggaggcaggaatgcctgggacactcgcggggcatgtgagcaggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctg

SEQ ID NO: 6843 - DNA, 1058 bp, Homo sapiens
agtctctctaggcgcagctcccttcgccgcttccggagcccctggcagggcccagaagccatggcccactataagactgagcaggacgactggctgatcatctacttgaagtatttactctttgtcttcaacttcttcttctgggtcgggggagcagccgtcctggctgtgggcatctggaccctggtggagaagagtggctacctcagcgtcctggcctccagcacctttgccgcctccgcctacatcctcatctttgcgggcgtacttgtcatggtgaccggcttcctgggcttcggtgccatcctctgggagcggaagggctgcctctccacgtatttctgcctgttgctcgtcatcttcctggttgagctggtggcgggagtcctggcccatgtgtattaccagaggctgagtgatgaactgaagcagcacttgaaccggactctggctgagaactacgggcagcccggagccacgcagatcaccgcctcagtggaccgactccagcaggatttcaagtgctgtggaagcaacagctcagccgactggcagcacagcacgtacatcctgttgcgggaggccgagggccgccaggtgcccgacagctgctgcaagacagtggtggtgcgctgcggccagcgggcccacccctccaacatctataaggtggagggaggctgcctcaccaagctggagcagttcctggccgaccacctgctgcttatgggggcagtgggcatcggggtggcctgcctgcagatctgcgggatggttctcacctgctgcttgcaccagaggctccagcggcatttttactaatggccaaccacctcctcttccaactgcccctcaagacaacatgtggccacatgccatctgcaaggcctgcagagttagcaccagctccactagggccatagatgccccctcctttgtgcctagctcctgcgaatccaccgagtgcctgagaccatagcttctgtgcccacccaggcagagaccctcggccccctctcctccatttctgagcccccatggccagatcctgggcaggg

SEQ ID NO: 6844 - DNA, 1037 bp, Homo sapiens
gccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctcca

SEQ ID NO: 6845 - DNA, 1380 bp, Homo sapiens
gggcaggctggggttgaaactcttcaccccttgcggtctgtactgcctcccaactgagcagccagggagaaggcctagagcctgtgcctttcagctagatagctggaggaactggctcctccctccttaggctgtgctggcctgagctgggagcctgagagctggggcagttgtctctaaagtggcttctgggattctggtaagaggacttggggtggagtcgaaagcagggagccctgtgagttgagacgaactcttgcaatgttgccttggctggtctcgaactcatcttctgggttcaagctgtccgtctgcctcggactcccaaagtgctaggattacagcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagc

SEQ ID NO: 6846 - DNA, 855 bp, Homo sapiens
acttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagtgctgccctgctttctctgtctctttcagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctg

SEQ ID NO: 6847 - DNA, 1095 bp, Homo sapiens
ctgccgccgccgcgcgcgggacttggggtggagtcgaaagcagggagccctgtgagttgcgttacatccttactattcaaagtgccatccacagacctgctgatgggcagcatgagcatcacctgggagcttgctgcgctgtagaatcttgaggggtctccatccagatcagctgaatcagagtttgcattgttaacaagattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagc

SEQ ID NO: 6848 - DNA, 1439 bp, Homo sapiens
aacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctact

SEQ ID NO: 6849 - DNA, 5476 bp, Homo sapiens
ggccgagccgggccgcgccgccgctgccgccgccgcgcgcggattctgcttctcagaagatgcactattatagatactctaacgccaaggtcagctgctggtacaagtacctccttttcagctacaacatcatcttctggggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaa

SEQ ID NO: 6850 - DNA, 5691 bp, Homo sapiens
ccgcaccgggcggcgcagggaagcggcgccccttcctcggcagacggcaggcgccgcgcctccggccccgcccctccgcgcccctccgcgccccgcccccgccgctcggacggcccgagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaa

SEQ ID NO: 6851 - DNA, 808 bp, Homo sapiens
cgccgctcggacggcccgagtcgcgccctcccgccccgcgccgcggaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatg

SEQ ID NO: 6852 - DNA, 1040 bp, Homo sapiens
tggacaaccatcaggcagccaggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagaggtgggggtctcgctatgttgcgcaggctggtcttgaactgctggcctaaagcgatccccccgcctaggcctcccaaagtgctgggtttaccagcgtgagccaccacgctgggcttcctgcatccttttaaggttcctgagggtctgcctgagaggagctgtccctgaatctccatgcagccccacctgccacatcaccaag

SEQ ID NO: 6853 - DNA, 1026 bp, Homo sapiens
ggacacagaggggcagagcaagtcagcattggcgccccttcctcagatccctatcatcttgggaaacagtagcccagaggttcaggaagatgttaacttaaatgttcagggtgccccagtctgttcagcatggctgaaatccacactccgtattcttccttgaagaaactgttatctttactcaatggcttcgtggctgtgtctggcatcatcctagttggcctgggcattggtggtaaatgtggaggggcctctctgacgaatgtcctcgggctgtcctccgcatacctccttcacgttggcaacctgtgcctggtgatgggatgcatcacggtactgcttggctgtgccgggtggtatggagcgactaaagagagcagaggcacgctcttgttttgcatcctgtcaatggttattgtcctcatcatggaagttacagctgccacagtggtccttcttttctttccaattgttggagatgtggccttggaacacaccttcgtgaccctgaggaagaattacagaggttacaacgagccagacgactattctacacagtggaacttggtcatggagaagggactctccaagtatttcttctcctctctatagctaaagtgctgtggggtgaataactacacagatttttctggctcttccttcgaaatgacaacgggccacacctaccccaggagttgctgtaaatccatcggaagtgtgtcctgtgacggacgcgatgtgtctccaaacgtcatccaccagaagggctgtttccataaactcctaaaaatcaccaagactcagagcttcaccctgagtgggagctctctgggagctgcagtgatacagttgccaggaattcttgccactttgctgctgtttatcaagctgggctgacacccaggcctggagaagatgagacacctgggcccatctggctgctggagattcagtctcagttttatttctctgtggcactcactgcttctggaggggagactgttaataaaagatttgggaaccccc

SEQ ID NO: 6854 - DNA, 2550 bp, Homo sapiens
ggcggggcccggtccagaggcggggacagcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggtgagaggggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggttt

SEQ ID NO: 6855 - DNA, 2555 bp, Homo sapiens
ggcggggcccggtccagaggcggggacagcagggctccgggcaaggaggtctggatgctgagggcggtccctgaggggcgggcggggcccgaccggcgctctgtgtggccgaggccatgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggtgagaggggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcattgtgc

SEQ ID NO: 6856 - DNA, 2457 bp, Homo sapiens
catgaagccgcagccgcccggctaggccccgggcggctctagcccagggcggcccgcggggcgctgggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgtgagtgacatcaaggcagtgaaagccaactggagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagca

SEQ ID NO: 6857 - DNA, 2361 bp, Homo sapiens
ggcctggctcccggctccggtttccgggccggcgggtggccgctcaccatgcccggcaagcaccagcatttccaggaacctgaggtcggctgctgcgggaaatacttcctgtttggcttcaacattgtcttctgggtgctgggagccctgttcctggctatcggcctctgggcctggggtgagaagggcgttctctcgaacatctcagcgctgacagatctgggaggccttgaccccgtgtggctgtttgtggtagttggaggcgtcatgtcggtgctgggctttgctggctgcattggggccctccgggagaacaccttcctgctcaagtttttctccgtgttcctcggtctcatcttcttcctggagctggcaacagggatcctggcctttgtcttcaaggactggattcgagaccagctcaacctcttcatcaacaacaacgtcaaggcctaccgggacgacattgacctccagaacctcattgactttgctcaggaatactggtcttgctgcggagcccgaggccccaatgactggaacctcaatatctacttcaactgcactgacttgaaccccagccgggagcgctgcggggtgcccttctcctgctgcgtcagggaccctgcggaggatgtcctcaacacccagtgtggctacgacgtccggctcaaactggagctggagcagcagggcttcatccacaccaaaggctgcgtgggccagtttgagaagtggctgcaggacaacctgattgtggtggcgggagtcttcatgggcatcgccctcctccagatctttggcatctgcctggcccagaacctcgagcaaatggaatgatgactttgaaaaccactggcttacgcccaccatttccgaggtcctgtccacggcggggcctcagcagaactctctgactggggcccctggcccggccccacccagccgacatgttttctttggcctgggtggtttataccctgagccaacctttaaaaattggtagatttcacataaaagtccagatccacagcttctcttgaagaatgaccacctggctacgccggctcttcggtggcaacactacctgggacactgcctccccagtcaccaagggccccagctggcccgttctactcacctaagtgccgcctgacccttgtacactaggagctggcctcccacctctgcagggttattccctgcacctcgaggccgctgcgggccaatctggagtgaaacacggggacctgaaggatggagaggctggaccccgctttgaagagggtgcagcctgggaagggcggccttgctggggactgcggtgggagtagagtgcccaggagagggtctgaggggtgggatgggggtcaggacaattttgcaaaagaagtagctggaagccatgggactggcgggagcctgtttgggggatctggatggttgactcctaggagtcaagttcagcatcttcaccgtggctgcagagctgcctgatgggcactagagggcatgccagccccacactccctgggtctggcttcctcccgcaacctcactctagtagagcctgtgcctgcctactagcgctctggggttcggagagtttgggaatttctcagagccaactggctcaggcttgggaaggctggctgctgccctcagctccgcctcatcagctatgtgaaggggtgtgtgtggagtgatcctgccgccccctccctgggctcgtccagagatctcaaactccgatgcccctggggccacgtatgttgtataaatggatgaaacaggcccttgagttgggagcctgcttcactttgactttcccactgttgctggagacaaagacatcgtgatgagagaaagttcgcacaatctagtcggtaacagccactttccttgagaccaagagagtgcggtggggatgggggggagagcacgggtccccgtctgacagtggccgctgccatattcaggtgtagctaattgctctggtgtgggaatgcaggcctaatgacagaaatctggagaagccagaaatacagatttgtatgtgagatgtcctgattttttaagttgttggcagaaattaattcagaaatcaaatctgcaggccaaacaaggtgcaggacccagctttggccccatgcccctgtaggtccctctgggacagtcaccgctggggtcctggctgctctgtcattgagggatgctgggcactgctgccgggtggccagggtatggggcatgtgcccagcaatgtggctccttggccccgctggccagtgtcctgggcccctgacaggcgctggctgtgagtggtttgtacatgctacaataaatgcagctggcagcatt

SEQ ID NO: 6858 - DNA, 4229 bp, Homo sapiens
agtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaacaaaaaacaaaaaacccatgctgggcaggactgaggcaaattgcacagctttatggctctaatccaggggcatcccaggcttctggggcccacagaagtcagagggaggacccaagagaaagggctggtcatgaagggaaatctggctaaggtgggttcaagggcagacacaagactgcccctcagcagctttctacaaatgtgccaaggaaccctcaatcagccctgattcagctcgccagccagccactggccaccctcttaggctggaaagggaagacaggcagtttctgctcctgttggcattcgctcaggctggtagctatttgcaagactgcctgaggccattccttggaggcaaggcaaagaaagctcagcccaaatcaggcttgagcctccctccagagcacagggagaaacagggtttagctggcttggtccagatacaacccacagcaggttctggtggtggctggggttgtgggggaggggtgggcagggatacctctttgtttcttttcaccccgaaatacaacagcccataacagagacttcctcggaccccactaacagggcaaggaacaagaagactacaccgctcatcacaaaccctgcctgtatcgaaagccactttcctgctctgaagctactgcctcttagagaaagggaatagctctttatgggctgggggtgagggcccctccccagggtccctgttaatttctggccttggtgctcaggcctgtccacagcctcccttgtctatgtctctatccatgcttaaggggcccggacaggatttcccaaaccagccgaggccccagcacccgccgtctccccagaagccccctcctccttcccccatgggtcatatgttgaaagtctattttaaaaactatgttccttgccgtagattgcagagctaatttatcacgtttctctcctgtgagaccccccttttatatgatatatccagaggaagttttgtaatataaaacaggacgcccacactgatggttttgcactggtttttgtgaatgtttcttacaaaaagaaaaaggaacaaagaataaatagtgaccgtg

SEQ ID NO: 6859 - DNA, 1184 bp, Homo sapiens
gtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaacaaaaa

SEQ ID NO: 6860 - DNA, 3316 bp, Homo sapiens
cggccccgagccccgagcgagcgccgccgcctcgcgctgcgggtccccggacgcgccgccaccgccgggaaggcagccggcgccgggcaagttgcgagcgcgcccctccgaccaggaaagtttccccccggccgccggcgggatttggcgcggggtccggcagccgccgctggaagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacatttggttgctgcggggtcaacgggcctgaagactttaagtttgcatctgtgtttcgactcctgaccctggatagtgaagaggtgccggaggcctgctgccggagggaaccccaaagtcgggacggggtcctgctgagccgggaggagtgcctcctgggaaggagcctattcctaaacaagcagggctgttacacggtgatcctcaacaccttcgagacctacgtctacttggccggagcccttgccatcggggtactggccatcgagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatctcaaaggcccagagaggacagtgaccatccacagacacacagcacaggcgtgacagttctgaaaagaagctgagttgtctccaggctgctgtcactgcatccaggactctgtcagctctgctgcccacatgcacccctggcctcagcatcccggttcccccagacaagagagggcaagtcagccaggaactgcctcctccctgctctacagctaagaaaacaccattccatgacttcccaccgcgccctcgctcctacctccccacacctctctctgagtccccaggaacacacagaggtgcacatcacattcccttgtccacactgcccgcctctcccacatgccacccccttccctgtccttccccaactccccagctccaagagtggaagaaatccccaagatcatctgggtctccctctccacacccagaactgaggcttggatatcttcttcaacatccttgccaagacttctccaccctcttgcatacctccagggacagagagcttactacctcccaaggcagcctcctgcctttggactgctctgactttagcatcagcttaatacacagaagaggtttctgtttttctgtggctctgtccatggcatcccacttgcccactctccttcctggagtgttgaggtcacacattgactcccctgagccctcttctctccaggctaaagaatcccgaaggcatcgaggccatttctgctgcaacaaggtttcctgtctcttcactgtccgcacatttcttagtattccctccaggcttgggcagggagactcgcagatgcacacccacaagtattcagttctcaaactctagacgagtgttggcaactggattgcaagatgctcctaccctgatagatcaggggtggctgctggaggctgtgctggggatctgaggtttggtctgggctcagtgggagacggcagtgcaatcctgatgagtgatgtctgccaggcaccgtaagtttgattagtgatgtctgccacgggcagggatggaaggagcagtgtgatgtctgctctcttctctcccctctgtccctcttcaggaagaaagagctcattctgtctcacaagccaccggcatcctgtatcagcttccagcctcccctcaggctttccagtcaccagggacactcggagccacagcctagagccccgtgttccctggcctgtgcgtctgcccccttctgagatgcagccagaagctctgtgcctgctgcaaagattcaggtggaccctcctctaatctcctcctgctgtgcccgccagtccttgccctcccaccaggtctctgagctcagtgttaccaaattcgccctttaacagcttgctctggcaaccccataaatgacacctgaggtccgtagaagctaagctcctgagacccagggggacctgccactggtaccgcggcccagcctggggcctgggggctgcccctcttgaaccacccacatgcttagccccagctttttggaagaggcaaatggctggtctgaggatgacacacaaaaaca

SEQ ID NO: 6861 - DNA, 549 bp, Homo sapiens
aggcgaggggcagcccgcagaggagacgcgcttctcggcagcaacggcgtctggagccgggaggggcggagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaa

SEQ ID NO: 6862 - DNA, 726 bp, Homo sapiens
tttcttatctgcaagtcagaggagggtgagttccccaggctttcaacagagtgtatccagaagctactgtcaggaggacactgtaagagaaccttggcacctctgggcccaaagggaaagacaccagtggaaagaggtgagcatctcctggaccaccctcaagcttcaggtgagctgagcttctaacactaccatcaaagcaactggaaccccttgaatttgatttctggagacgcgagcataatccttttgcagacatctcaacgctggctctccaggtggagcaccatggaaggcgactgtctgagctgcatgaagtatctgatgtttgtattcaatttcttcatatttctgggcggggcctgcctgctggccatcggcatctgggtcatggtggaccccaccggcttccgggagatcgtggctgccaatcctctgctcctcacgggcgcctacatcctcctggccatggggggcctgctctttctgctcggcttcctgggctgctgcggggccgtccgtgagaacaagtgtctgctgctatttttcttcctgttcatcctgatcatcttcctggcagagctctcagcagccatcctggccttcatcttcagggaaaatctcacccgagaattcttcaccaaggagctcaccaagcactaccagggcaataacgacacagacgtcttctctgccacctggaactcggtcatgatcacagtgagt

SEQ ID NO: 6863 - DNA, 1883 bp, Homo sapiens
cgggctcctgcacggcgcggctcggctcatgcccccgggcgcggggcacacaggccggccggcagccgctgggaaataggcccccgggggcggtggcggcggcggggccatggcgcggagaccccgggcgccggccgcctccggggaggagttctccttcgtcagcccgctggtgaaatacctgctcttcttcttcaacatgctcttctgggtgatttccatggtgatggtggctgtgggtgtctacgctcggctaatgaagcatgcagaagcagccctagcctgcctggcagtggaccctgccatcctgctgatcgtggtgggtgtcctcatgttcctgctcaccttctgtggctgcattgggtccctccgcgagaacatctgcctcctgcagacgttctccctctgcctcaccgctgtgttcctgctgcagctggccgctgggatcctgggcttcgtcttctcagacaaggctcgagggaaagtgagtgagatcatcaacaatgccattgtgcactaccgagatgacttggatctgcagaacctcattgattttggccagaaaaagtttagctgctgtggagggatttcctacaaggactggtctcagaacatgtatttcaactgctcagaagacaaccccagtcgagagcgctgctctgtgccttactcctgttgcttgcctactcctgaccaggcagtgatcaacactatgtgtggccaaggtatgcaggcctttgactacttggaagctagcaaagtcatctacaccaatggctgtattgacaagttggtcaactggatacacagcaacctattcttacttggtggtgtggctctaggcctggccatcccccagctggtgggaattctgctgtcccagatcctagtgaatcagatcaaagatcagatcaagctacagctctacaaccagcagcaccgggctgacccatggtactgagaatccatcctgcacctcctcaccatggaaactggcaagcctcataaacgaacagcagtgggtgctgaaagcagcaccaaatggagatttggattccagccccccagtgacagcccagtgggaagaagcaaactccagatgggcagaaggcagggtgcacaggtggctccagtctcaggaggatgcgcctcctctcccccatcccagccctcagcattgtgccagagtgatacccttaagtgtttgggtttatgttttcagttttgtttgggaaacagcagttgcacagagagttgggggtactgctgctgccttttcaccgaggcactgccaccaccagctctagcagggatgctcctgagcttggcggacatacttagatcctaacgtgccagtgagacctggctgtggagagtagcactggcagccctgcctggactccacttggcatgataccagctccagaagggaagggagtggagcaggcagtgaggagagagcctgggggtcggctggggacagccgtatgtgctaggtaggagtggagggagatatgtttaccaaatgcctgtcctgccatcctcccaggtagtcagagtgagctacatcctgccccgccttcatttccatggaaacatggcagctaggacacggggtacaacagcagccaaattcttccccacctcccttacttcgaaaaaaagtttggaaccctggtccctatactctgcagtcagaagtgggactgagccatacatgcccttgaattcctccctgtctggccctccctctccagcaagcagggttttctttaacttggcagtgtgcagaggagaagtggtaacacccccaccccattcccctgcatcggagctcagtattcctacagggtaagaggtaggaatcttgctgggacgagggg

SEQ ID NO: 6864 - DNA, 1243 bp, Homo sapiens
gccctctcaccccgctgcctctaggttctgggaagatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttaaggtttcaaaaactctttgacattagatttcacaactgcacaattgaacttattggcctgtaacttatttactaaatgctcagtgctatttatatactacagtaattttctgttaagaaggcagttgtaaagaatgtgtttatataaacctaaaaatgccttttactgctaagtggggagatgggggaaatccatggaagagagatttaagacttattgattgtacatcagtctcttcatatcacatatacatgtatatatataaaactctaatgtagtataaccttgttaaataaaccatgatgatttattaaa

SEQ ID NO: 6865 - DNA, 7470 bp, Homo sapiens
ccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgaagcaaaggccgataatgaaccgagctgttcgccggcagctcaagaactgttgacaaggctgggatttttactgggagaagggatcccaagtgccacacacataaccattgaagacaaaaatgaaaccatgtgcacagctctgagtcaaggcatcagtccttgctccacactaacaagcagcaccgcatctcctagcaccgatagcccctgctcaaccttgaatagctgtgtcagcaagacggcagccaacaaaagtccctgtgagaccattagcagccctagttccaccctggaaagcaaggacagtggaattatagccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaatggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaatagaa

SEQ ID NO: 6866 - DNA, 7185 bp, Homo sapiens
agcggaggctttgctgtggcagctgctggagcggcggccgcctcgggagccggaggagaggcagccgcggagcgccgagctggcctcgccccgaggcccggccctgggtgtggggaaccgcgctgaggagctggaaactttcccggcaggagctgactgctgggcaggaacgtctctcaggagaaagagtggaagagaaaattgtgaactaaggccccctgcccccttttcctggtgcatgtgaagttatcaaaaacagaaacaagtgttgaaaatgttaaaggctgtgctgaagaagagccgagagggaggaaagggaggcaagaaggaagcaggaagtgactttggtccagagacttctccagtcctgcaccttgaccacagtgctgactctcctgtgagcagtcttcccacagcagaggacacctatagggtgagcttggccaaaggtgtctcgatgtctctgccttcctcacctttgctgcctcgacagtctcacttggtgcaatcaagagtgaacaaaaaatccccaggtcccgtcaggaagcccaagtatgtggaaagccccagagtgcctggagatgcagttataatgccattcagagaagtagccaagccaacagagcctgatgagcatgccacaattacaagttcatccgaaaatgatgaccggagtggctccagtttggaatggaataaagatggaaacctaagattaggggttcagaagggagtgcttcatgaccgcagggcagataactgctccccagtggcagaagaggagaccaccgggtcagcagagagcacgctgcccaaagcagaatcctcagctggagatggtccagtcccttattctcagggctccagctcactaataatgccacggcccaactcagttgcagcaacaagctcaaccaaattggaagatctgagttatttagacgggcagagaaatgctcctctacggacgtcaattagattaccatggcacaatacggccggaggtagggcacaggaagttaaagcacgatttgctccctacaagccacaagacattttgttgaaacccttgttgtttgaagtaccaagcataacaacagactctgtgtttgtgggaagggattggctctttcaccagatagaagaaaacttgaggaacacagaactggcagaaaacagaggcgcggtggtggttggcaatgtgggatttgggaagacggcaatcatttccaagttggtggccctgagctgccacggaagccgcatgaggcagattgcttccaacagcccgggttcatcacctaaaacctctgaccccactcaggatcttcatttcactccgttgctttcaccgagttcttccacaagtgcttccagcacagctaaaacacctcttgggtctatcagtgctgaaaaccagagaccaagagaggatgcagtgaaatatcttgcttctaaggtggtggcctaccactactgccaggctgacaacacgtacacttgcctggtgcccgagtttgtgcacagcatcgcagctttgctctgccggtcccatcagctggccgcctacagagaccttctgataaaggagccccaactacagagcatgctgagcctccgatcctgtgtgcaggacccggtggcagctttcaagaggggagtgctggagccactcacaaacctgagaaatgagcagaaaattcctgaagaagaatacattattttgatagatggcttaaatgaagctgagtttcataaacctgattatggagatacgctttcttcatttattaccaaaattatttctaaatttcctgcctggttgaagttgattgtgactgtaagagcaaattttcaggaaatcataagtgcgctgccatttgtcaagctttccttagatgacttcccagacaacaaagacatccacagtgacctgcacgcctacgtccagcacagggtgcacagcagccaggacatcctcagcaacatctccctgaatggcaaggccgatgccacactcattggaaaagtgagcagccacctggtgctgcggagcctcggctcctacctgtacctcaagctcaccctggaccttttccagaggggccacttggtcattaagagtgccagctacaaggtggtgcccgtgtctctctctgagctctatttgcttcagtgcaacatgaagttcatgacccagtccgcctttgagagggcacttccgattctcaacgtggccctcgcatccctccaccccatgacagacgagcagatctttcaggctattaatgctggccacatccagggggagcagggatgggaagactttcagcagaggatggacgccctctcctgcttcctcattaagaggcgagacaaaacccgcatgttctgccacccgtccttcagggagtggcttgtatggagagcagacggggaaaacacggccttcctgtgtgagcccaggaacgggcacgcgctcttggcattcatgttctcgcgtcaggagggcaagttgaaccgccagcagaccatggagcttggccaccacatcctgaaggcgcacattttcaagggcctcagtaagaagacgggaatttcttcaagccatctccaagccctgtggatcggctacagcaccgaggggctgtccgccgccctggcctctctcaggaatctctatactcccaacgtgaaggtgagccgtctcctgattttgggaggggccaacgtgaactacaggacagaagtgttaaataatgccccaatcctgtgcgtccagtctcaccttggccacgaggaagttgtcactctgctcctggaatttggtgcctgcctggacggaacgtcagagaacggcatgactgccctctgttacgcagcagctgctggccacatgaagctggtgtgtctgctgaccaagaagggagtgagagtggaccacttggataagaagggccagtgtgcgcttgtccacagtgccctacggggccacggtgacattctccagtacctgctgacttgtgagtggtcgccgggtcctccccagccaggcaccctgaggaagagccacgccctgcagcaggcgctgaccgcggcggccagcatgggccacagctcggtggtccagtgcttgctggggatggagaaggaacatgaagtagaagtcaatggcaccgacacattgtggggagaaacagccctgactgccgccgcaggaagagggaagctggaggtctgtgagctgctgctggggcatggagctgctgtgtcgcggacaaacaggagaggggttccacctttgttttgtgcagcacgccaggggcattggcagattgttagactgctgttggaacgcggctgtgatgtgaacctaagtgacaagcaaggccggacgcccctcatggtggctgcttgtgaagggcacttgagcaccgtggaattcctcctttcaaaaggtgcagccctttcttctctagacaaagagggtctgtcagcattaagctgggcttgtctgaaaggtcacagggcagtggtccagtatctggttgaagaaggagctgcaatagaccagacagacaagaatggccgcacacccttggacctggctgccttctatggcgatgccgagactgtgctgtacctggtggagaagggagccgtgatcgagcatgtggaccacagcgggatgcggcccttggacagagccatcggctgccggaacacatctgtagtggtggcgctactcagaaagggagccaagttaggaaatgctgcttgggcgatggccacttccaaacctgatatcttgattatacttttacagaaattaatggaggaaggaaatgtgatgtacaaaaaagggaaaatgaaagaggcagcccagaggtaccagtatgccttaagaaagtttcctcgagaaggattcggagaggacatgagacccttcaatgaattaagggtttccctctatctcaatttgtcgcgatgccgaagaaaaacaaatgactttggcatggcagaggaatttgcttccaaggctctcgaattgaagcccaagtcctatgaagccttttatgccagagcaagagcgaagagaaatagcaggcaattcgtggcagctctggctgacctgcaagaggctgtgaaactctgtcccaccaatcaggaagtcaagaggcttctggcccgcgtagaagaggagtgcaaacaactccagaggagtcaacagcaaaaacagcagggcccgctaccagctccactcaacgactccgagaacgaagaggacaccccaacccctggcttaagtgaccactttcactctgaggagactgaagaggaagaaacttctccccaggaagaatctgtttccccaactcccaggtcccagccatcctcatctgtcccttcctcatacatccgaaaccttcaagaagggttacagtccaaaggaaggccggtatcgccacagagcagggcaggaatcggcaagtccctgagagagcctgtggcccagccagggctgctcctgcagccctccaagcaggcccagatcgtgaaaaccagccagcacctgggctctggccagtcggcagtgagaaatggcagtatgaaagttcagatctcttctcagaaccctcctccaagtcccatgccagggagaatcgctgccactcctgctgggagcagaacccagcatttagagggaacaggtactttcactacaagagctggttgtggccactttggggatcggctgggccccagccagaatgtccgcctgcagtgtggtgagaatggccctgcacaccctttaccaagtaagacgaaaaccacagagaggcttctgtctcattcctccgtggctgtggacgcagcccctccaaaccaaggtgggctggcgacctgcagcgacgtgcgacacccagcttccctcaccagctcaggctcttctggttctccatccagcagcataaagatgtcaagttcaaccagtagtttgacttcgagcagcagtttttcagatggcttcaaggtccaaggaccagatactagaattaaagacaaggttgtaacccacgttcagagcggtacagctgagcacagaccccgcaacacgccgttcatgggcatcatggataagactgcgaggttccaacagcagagcaatcctccaagccgcagctggcactgtccggcaccagaggggctgctgacaaacacgtcttctgcagctggcctgcagtctgctaacactgagaagccctctctcatgcaagtgggaggatataataaccaagccaaaacctgttctgtttctaccctgagtgcaagtgtccacaatggggcacaagtgaaggagctagaagaaagcaagtgccaaattccagtccactctcaagagaacaggataactaagactgtttctcatctgtaccaggaaagtatctccaaacagcagcctcatattagtaatgaagcccacaggagccacctcactgcagccaaaccaaagcgatcatttatagagtcaaatgtgtgaaccttaagaaatccccatttgtggaatttggaaacgtgtgttgactcctggtggtaaattaaatagtttttttcatcagaaaaattattttttagccattttttttctttggggtggatctgatgccattgatatatctaaaatgtgggataaaacttctttaatagctagaaatcaccataaataagaatgctaaacagaattgaaaattatatcaacttaaaattttaagacagcccagaagacattaatgactctcacttatgaaattgtttggcttttgccactttcttccttgcctttgctatatggtagaatcacagaacttacttagagaataaatatgtctattgttcaagagtaacaggtttaactcatgaccaagtgatgtacatccaagtgatgtattctggaaacgatggaattttacagttacagttccattgagtcaaatcccattttatatatacataaaaattaagttctgagtgagttctagctaaatataagtgcgactgtaaacgcagccaatttttttaagcagaatatgagaacacctaagtattctcttcatagcagttcctataaagggattaaacacttatttctgtgttatggttcttattcatatatttttatagcacttttggaacctatatttgtgcttgaaggtgtttttgatatttggaaacagtataagccatttggagtcatgattggtggtcaagtggattcaagctaaaatactaagaccagcattcttagtggcgcttataaattagctctcacctggtttccaaactgcttttaacaatggtagtgctcctggaacaatccttccaagctcctctaaggacaatatttaattcagatactaaaggtaagactggttgttacttttgttttgttgtacaattagtactttatagtcacatgttgtatatattaaatagcccagttttattcagacttgtaaatagaactatttcaatgtagttaatctaaaaacaaaaaagaaaaccccagtcacgatttgcatgttctctgtaagcttcatccatgctggttattgcactgaatgatatattattagggcatgttaacagtataccagtaacagcactttatctcatttatatgaacacctttgaggtgctacttaagtccaagctctgatgtattattcatttgtaaagataaggtacaggaatgaaccttggtttaaaggtatttttatatgaaaatggtgtgttattggaagatgttaaaatgctaatttgagagaagtaggagtgtatctgttttatatgttgggatgtgaaatttattttctaaaattgaggagaaggaagttatatatttgcagaatgttttaaagtgaattgttgtaatgaagttcctgtgaacatcattatggttttgtacaaataggaacctctgatgtcattcttcaacgtttgttcctgtgtgtacaattgtactttgtatgaacagctttatcatttttataggctttccatgagttttgctgtaactactatggcttatttattttctttaatatttgtgaaagtcttactcctttgttagttttgtttctgcacaactactgtacttttccatatggaataaagactattaat

SEQ ID NO: 6867 - DNA, 3776 bp, Homo sapiens
cacatgaccattggctggagcccagttgaccaagaaggaagccagagaaagccacacattcgggcgagcaaggatcacaaggagacacatctgagcctgatatagaggattgcacatcagcacatcattcagagatcctggactttgagatgtatgtagtaacaggacactgtcttcagccttttcttcaagtttttgaccgtggattgtgttgtgtcaaactggatgaattatcttagttgaattttcaccagttgaaaaattggagatttctagactactgaaaagaagttgctttcagagctggagatgtgaataaaatttctgtgccagggttgataaaccatcttgaggattccatccaggaaaccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagaggaaactttgatccaaaagccatgaataatttttatgacaacatagaacctggcccagttgtaccacccaagccatctaaaaaagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgtt

SEQ ID NO: 6868 - DNA, 405 bp, Homo sapiens
aacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagagaagtatactacagcagaagctctcttaaactttcatttacccaactcaccagattagagatggtcttcattttctgtggaaaatatactgactgatgtccacagctgctgcatacttttgactagtaggctgcattctggaaactttgatccaaaagccatgaataatttttatgacaacatagaacctggcccagttgta

SEQ ID NO: 6869 - DNA, 6255 bp, Homo sapiens
tgtaactagacttaaccatactttttttttttttttaaatagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagaggaaactttgatccaaaagccatgaataatttttatgacaacatagaacctggcccagttgtaccacccaagccatctaaaaaagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattgtcaaaaattattaagagaaaggtgaatatagaggactttgaaacaacttttaaaatttaacataactgtatctagaggtcaattgagtctctacaggcagttcagatcattttaaagcactccttatttatgaaatagaacttcagggtgcggataagagatataaagtcatgtgactcactagggtgcatcgctggaaacttaatagcacatttcattaaggtctctgccattgttggagttccttcttagctcagaattggagttttggaatcttcccctcattttggtgagtataaacagcaataaagttagtaggttctcccatcctaaaggattttacctgaggatatcgtcttaggaatatccatagacgctcccatcaggtttctcccccaacccccctacaccgcccccccacttctaatttagcagtaatctctggcagacctggaaaaacaagctgctcttaatagcataatgaaaccaaaggcgtaataactcatcatagttttccatcagaatcatttcacactctgcctacagctttgaaaacattttttcatatgtgaaaaactccccaaaatatatccactagtctcccaaaggaagcatggtaattaacactgataaaaacatctctcacacaacaactgtggcaaaactgtgaaaataacggtgagaaagcagatgggcttaaaagcatggtccccaaaacaacgttcttcaaaggtttttgtaacactggtctctgtctccaataacagtctagccgtcctactgttctgtaatatgcctttgcctttgtatggtttcatatctctttagtgatggtcaaccccacttggttttaagttacaatttaggggaaatatatatatatatactgcttggtgtcctagctaaaaggtttaccagtattcatagtgatatgctgaagtggaggcaattaacttggcagttgtcagttgagaatgaaagtagcatgtctgaaaacagtctgatgctttataaaaccatgtagatgactttaaaactattgcatgaaaatacatcaaggttaataagctgttatacagtagatgcatggtttcaatcctttggtgatattatctagtcaatcattgttttcacctgccaggaaaagagagaaaacagtctattggataggtgtaaagggtggggtatgcggtatcagattgattttaaggaagttttgtacatgttaatttttaattgtgcacaagtttcatatgccaacataggctgtattcagttttaaaataggcaaaatgacttgacactgataaatctggtatgtttaactgtgtcccatatgtagactgctttttgcctatgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacact

SEQ ID NO: 6870 - DNA, 3692 bp, Homo sapiens
cacatgaccattggctggagcccagttgaccaagaaggaagccagagaaagccacacattcgggcgagcaaggatcacaaggagacacatctgagcctgatatagaggattgcacatcagcacatcattcagagatcctggactttgagatgtatgtagtaacaggacactgtcttcagccttttcttcaagtttttgaccgtggattgtgttgtgtcaaactggatgaattatcttagttgaattttcaccagttgaaaaattggagatttctagactactgaaaagaagttgctttcagagctggagatgtgaataaaatttctgtgccagggttgataaaccatcttgaggattccatccaggaaaccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgtt

SEQ ID NO: 6871 - DNA, 6302 bp, Homo sapiens
ccccatcacagttggttgttatgtctccttagactcctcttggctgtgacagtttctcagacttttgttcttgaggagtactgatcagaaaatgactgtggtgctagaagatcattacttttggaaagccggttaacatccatttcctaagagaaacttggccaccatttgctctggcatggcgcaaagcagcccacagcttgatattcaggttctccatgatcttcgacaacgtttccctgaaattccagagggcgtggtgtctcagtgcatgttacagaataacaacaatcttgaagcctgttgccgagccctttcccaggagagtagcaaatacttatatatggaataccatagtccagatgacaataggatgaatagaaatcgccttttacatattaacctgggtatccattctcctagtagctatcacccaggagatggagcccaacttaatggtggtcgaacactggtacatagctcaagtgatggacatattgatcctcagcatgcagcaggtaaacagctgatatgtttagttcaagaaccacactcagctccagctgttgttgctgctactcccaactacaatccattttttatgaacgaacagaacagaagtgcagctactcctccttcacaaccacctcaacagccatcttccatgcaaacaggaatgaatccgtctgctatgcaagggccttcaccaccaccgccacctccttcatacatgcacatacctcggtatagtacaaatccaattactgttacagtatcccagaacctcccttctggacagactgtaccaagagctttacaaattcttccacaaattccaagcaatctctatgggtctcctggttctatttatattagacagacatctcagagttcatcaggaagacaaactcctcagagtacgccgtggcagtcctcaccacagggcccagtgcctcactatagccagcgtcctttacctgtttatccacaccaacagaactatcagccttctcagtattctcccaaacagcagcagatccctcagtctgcttaccattcaccacctccttctcaatgtccttcacccttcagctctccacagcatcaagtgcaaccttcccagttgggccacatctttatgccacctagtccttcaactactccaccccatccatatcaacaaggacctcctagctatcagaaacagggaagccattcagtagcctatcttccatacacagcatctagtttatccaaaggttccatgaagaagatagaaattacagttgaaccttctcaaagacctgggacagcaattaataggagtccttcacccatcagtaatcaaccatctccatggaatcaacactcactgtacacagccaccacgccaccttcaagttctccttcaagagggatatctagtcaaccaaaacctccatttagtgttaatcctgtgtatattacatatacacagccaactggaccttcttgtactccatcaccatctcctcgagtgataccaaacccaactacagtttttaaaattaccgtaggccgagcaacgactgaaaatcttttaaatttagtggaccaagaagagcgctctgcagcaccagaacctattcagcccatttcagtgataccaggctctgggggagaaaagggaagccataaatatcagagaagttctagttctggatcagatgactatgcctacacacaagccttgctgttacatcaacgagcaaggatggagaggttagcaaagcaactgaaacttgagaaagaggagctagagcggttgaagtctgaagttaatggtatggagcatgacctgatgcagagacggctcagaagagtcagctgcaccactgcgatccctacgcctgaggaaatgacaagattgagaagcatgaacagacaactccagataaatgttgactgtacactgaaagaagttgacctccttcaatctagaggaaactttgatccaaaagccatgaataatttttatgacaacatagaacctggcccagttgtaccacccaagccatctaaaaaagactcctcagacccctgcacaattgagagaaaagcccgaagaattagcgtgacctccaaagtacaggcagacatccatgacacccaggcagcagctgcagatgagcatcgaactggctccacacaaagtcctcggacacaacctcgagatgaagactacgaaggggctccatggaattgtgatagctgcacctttcttaaccacccagcactaaatcgctgtgagcagtgcgagatgccacggtacacctgaattcagaaaagtctgcgccaggttgaaagtgaaactttgagcactaccagaagaaaaggaaacctcgggactctattcatccacccagccttttcattttcgattgcacagcggggaggaggaatggctttgtggtcgtcgttgtgctcacgaaaggaaaaatggggaggtcttttttttctcctttcttaactcactacagagtgagagatagaaagggatacttgaaactgggaaaggattcactctgtgaaagaatgtacacacagaagtcaagagctcttctgtggtggaatcccaattgttaaagttactgctgagtggcccttattttttaaagtagtactttgaatcatagtatgaaatgctacagtttatgcaaactgtgaattcccagagcagacttacctggtcaccgctctctggaaaaccaaggctccccgtgcttcttcccattgcttcctactaaagaggacaacaggaaaaagcacctagaatatttggggggggggggcaaattaattaagggtatttgtaattgctgcttttttcaggggtaatttccaacacacatacatgcacacaaacaaaatgttttaaaatgtgatttgtagcagtcaggaactaggcatatcatgcctttgtttaaaagtacaatcagaggtggtaagatgcctttggcttgtacagtgtgattcatcgagctctatcaacactggtaactaagacctacttatgccacataagagatgcatttttttaagttactgcatgtttttattaaggccattggttttcaaaataacaagtccttacaaagtatgattttataaatgatattctcgtaaaactgcgctttgccagtagcacagtgaatgtatgccaaatgcaagtccattccaaaatccatttggaaatcttgagctcagctgtggttcttaaacttttgcagtccatagggccttttttttttccttccaattttgtgataaattcatgatgtttacagcacagataaaactttgtgccataatcctaatttagctgaaatcaatattaactgttcaataaaaacttacttgcatatgttaacaaaccagtgtgaggggaattacagttggccaacgacaaagttgcacactgcattatttaggaaaggagggattgtcaaaaattattaagagaaaggtgaatatagaggactttgaaacaacttttaaaatttaacataactgtatctagaggtcaattgagtctctacaggcagttcagatcattttaaagcactccttatttatgaaatagaacttcagggtgcggataagagatataaagtcatgtgactcactagggtgcatcgctggaaacttaatagcacatttcattaaggtctctgccattgttggagttccttcttagctcagaattggagttttggaatcttcccctcattttggtgagtataaacagcaataaagttagtaggttctcccatcctaaaggattttacctgaggatatcgtcttaggaatatccatagacgctcccatcaggtttctcccccaacccccctacaccgcccccccacttctaatttagcagtaatctctggcagacctggaaaaacaagctgctcttaatagcataatgaaaccaaaggcgtaataactcatcatagttttccatcagaatcatttcacactctgcctacagctttgaaaacattttttcatatgtgaaaaactccccaaaatatatccactagtctcccaaaggaagcatggtaattaacactgataaaaacatctctcacacaacaactgtggcaaaactgtgaaaataacggtgagaaagcagatgggcttaaaagcatggtccccaaaacaacgttcttcaaaggtttttgtaacactggtctctgtctccaataacagtctagccgtcctactgttctgtaatatgcctttgcctttgtatggtttcatatctctttagtgatggtcaaccccacttggttttaagttacaatttaggggaaatatatatatatatactgcttggtgtcctagctaaaaggtttaccagtattcatagtgatatgctgaagtggaggcaattaacttggcagttgtcagttgagaatgaaagtagcatgtctgaaaacagtctgatgctttataaaaccatgtagatgactttaaaactattgcatgaaaatacatcaaggttaataagctgttatacagtagatgcatggtttcaatcctttggtgatattatctagtcaatcattgttttcacctgccaggaaaagagagaaaacagtctattggataggtgtaaagggtggggtatgcggtatcagattgattttaaggaagttttgtacatgttaatttttaattgtgcacaagtttcatatgccaacataggctgtattcagttttaaaataggcaaaatgacttgacactgataaatctggtatgtttaactgtgtcccatatgtagactgctttttgcctatgaccagtttgaacaagaattcacccaactttcaagatgccttttcaaaaggatcttgtagtcagttggtatgtacagacaattggcatggaagtggtaggatataaatcggatgacgcctggctgctgaggtgccagctggatcagctggtgcacttcttgtttcttgtaagaggtttctttaaaatgactagtttgatgtatctggtaacatataggcctgactatacattttacattatttcgctattttgtaaactgggattttagaaagcacgtttgccattttgttaaagtacattgccccttaaattttggagtagtttttaaaagtttaaaatggtaatagaggagccagaaactttttaagcattgtaaaatgttttgaattgatattgactttgtttggaagagagtagaggcagggggctttaaagaaacaaagaaatgcattgtaaaaatgtagttttagagcaaattaataatgatggtggggaaagtgttgctaatttgtttatttccctggaagaaatgggaagtgtgataagcagtttaatttttaaggagctggtctcaattttagtactttttaattatgcaaataaatcaatgtttccttaaattttgtcattgctttgtcacagttgtctagggttcatatccaaccttctgtggcaattcaattttatatagtcttttaagaggtaattgtaatgtatttctgacagtataaacaaaaagaatataaggcatagaagaattgtcctctaaaaatatcaatgatgtatcctggaatgtgaagatgtccctttatagttaaaaattgaattattttaatattgtaccattgttagaccttgaatgagtccatgttaccgtgtgtgtctgtatatctatctgtagagaaagaaaaatgacaactgaaatgttacttttaaaaatcagaataaattgggcactgtctgtgttgcaccactactgtatcttttcgaaagaattaacagtatttgcctattgtaaaggttaattctgatgacgttttcacattcaccagactttttttcctgtattatttgcatccccaaatatttaatacaagtagattctgcatggcttgggcattcagagattaatagaatgatgactcaattttaattctaaagccatgaaaagttactttgagactgaacaattctgaattatttatgatacccaatgtccatgtttctttccctactgtaaaagaattgatcagtttcttcattaaagcagcaaaaacttattaaatcttgtaaataccatgtctcttttagatttctgtgtatgctgtgaatgaaatcattttgagatgaaattgtacaaaggcattttaaaaggctctgcatgcatcgtacctccaaacagtacatattcggaaagtcaaagattcctgcaaaataaataaactaaaagcaaacacta

SEQ ID NO: 6872 - DNA, 2377 bp, Homo sapiens
gcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctacccggaccccgccggcctcacaccccggccagccagccgccagtagtgcgcaccgcctcctccccaagccccgccctgcgtccaccccaggggttaactcgcacgcgcgctcttgtggcggaggtagagtgcgccgtccagggctagagcaagcgcggccccgcggcccggagccatgctgaggagctgcgccgcgcgcctccgcacgctgggggctctgtgcctgccgccagtaggccggcgcctgccgggaagcgagccgcgacccgagctgaggtcattttcttctgaggaagtcattcttaaggactgttctgtccccaaccccagctggaacaaggacctaagactgctctttgaccagtttatgaagaaatgtgaagacggctcctggaaacgtttgccttcatataaacgtacacctactgaatggattcaagacttcaaaacccattttcttgacccaaagcttatgaaagaagaacaaatgtcacaggcccagctcttcaccagaagctttgatgatggcctgggctttgaatacgtgatgttctacaatgacattgagaaaaggatggtttgcttatttcaaggaggcccttacctggaaggaccacctggattcattcatggaggtgccattgcaaccatgattgatgctactgttggtatgtgtgcaatgatggctgggggaatcgtcatgactgccaatctcaacatcaattataaaagacctatccctctttgttctgttgttatgataaatagccaacttgataaagttgaaggaaggaaattttttgtttcctgtaatgttcagagtgttgatgagaagaccctatactcagaggcgacaagcttatttataaagctgaatcctgctaaaagtctgacataaagagctgctggtgaactccatctcattctcgcccctccagaagaagcagttgtcccccaaatactctgctccctcactgctgaatccctgtagggagaagcctgccaacagtgaccttccgaaacagccttctgaatacaaagaggattcagtttccatcttctcaactttttaacacagaaatacttcctgcgagcatatcgacaactctcgggccaggcgctgtggctcacacctataatcccagcactttaggaggccgaggcaggcggattgcctgagctcaggagttcaagatcagtctgggcaacacgatgaaactccgtctctactaaaatacaaaaaattatccaggcatggtggcgtacgcctgtagtcccagctactcaggaggctgaggcaggagaattgcttgaacccaggaggaagaggttgcagtgagccaagatcatgccacatcactccaacctgggcaacagaacaagaacccatctcaaacaaacaaacaaacaaaaaaaaaaaactcttgtctccttaggatatgttacctgctccactgcagactagagaaataaatgtgtattgaaccttttactgcaaacttgaaaatgctagaaaaccaagcatgaagaataaatacatggtgggaaacacacaggcatgtgcatatgcatatacattgtaagttagtaagttagaaagctagctttgttgtatctgaacacatgaatcttttttggtcagtgtaggaagcacagccagatcctataggaatgaatacctcaaatctgttgtctgagattctagagattaaaccactgtgccatttttaacccaggctgtactgttgtttcttaccaacagcataggttttcatcactggaaggagcctgtgttcatttcctagggctgctgtagcaaagtagtacaaactggattgtttaaaccaacaaaaactcattgtctctcagttctggaggccagaagttcaaaatcaaggtgttgaccaaggccattctcctgaaagtgctagggaaggagctgtccacgcctccctcctggcttctgggagcctcaggtgttccttggcttctagatgcatcattccagtcctccatcttcacatggcattccctctgtgtgtctccacagtgtcttccctctgtgcagatctatctctgtgtccaagtctcctctttttataaggaaaccagtcataatggacccacctgaatgacctcattttaacttgattacctctgtaaaaaatgtatttccaaataaagtgaccttatgaggtattg

SEQ ID NO: 6873 - DNA, 2503 bp, Homo sapiens
agcctcgcctagctctctgaaagaaagcctgcaacagaagggagagaagcggccccaagtgcagctgaaagcactccttgggagtcagccaagaccctccatccaagcagggctggatccttgcacttggccatgataaggagatgcttccaggtggcagcaagacttggccaccacagaggccttcttgaggccccccgtatcctgcccagactcaaccctgcctcagcatttggatcctccacagactccatgttctcaagattcttgccagagaagacagacttgaaggattatgctcttcccaatgccagctggtgttcggacatgctgagcctgtaccaagaatttctggagaagactaagtctagcggctggatcaagctgccctccttcaagtccaacagagaccacatccggggactcaagctcccatctggactggcagtttcctcagacaaaggtgactgtcgcatcttcaccaggtgcatccaagtggaaggacaaggctttgagtatgtcatctttttccagccaacccagaagaagtcggtctgtcttttccaaccaggctcctacctggaggggcccccagggtttgctcacggcgggtccctggcagccatgatggacgagaccttttctaaaactgccttcctggctggagaggggctgttcacactaagtctcaacatcaggttcaaaaacttgatccccgtggactctctggttgtaatggacgtagaactggacaagattgaggaccagaagctttacatgtcctgcatcgcccacagcagagaccagcagacagtttatgccaagtcctcaggtgttttccttcagctgcagttggaagaagagtctccccagtaacagtcactgtgcctgcaggagagccactgcctcccctgcctgcctcctgcctcctgcctcccctgcctgcctcctgcctcctgcctcccctgcctgcctcctgcctcccctgcctgcctcctgcctcctgcctcccctgcctgcctcctgcctcctgcctcccctgcctgcctgggacccatcaaagagcagggaggggtcctcaagcagcaattggtgaggcgagggaaaggacccttttctctgagtaaataaagtctcacagtcccattctcggcccagggcctttctgtggttggaaatcaaaatccttccagggcatctcacatacccaccttcccattcagcaccgactgaaaagatttactgagtacccgccaggtgtcaggcactgtgtgaggcaccaggcacccagaagtgaaagacagggccccggtctcaagatgcacaatgcgggagccaggtgccaagtcagagtgccctatcacgctcctcccacacccaccctggcttccatcatgagtgcagtgtcatctcagcgggaggaagggctaattttactctacaaaagcaatcagaaaacatcttctagaagaagctcttcctgaactgtctcaaaagttaagtggtgttcattaggcaggcaggggagaggaggatatcccaggcagaagggaagtaagaagtaagacaaaggtgcagaggtgtgaaagtgtacagggactttggagaagagcaaggtgttgaggagggcaggcgtttagggaaagagaaggtgggcaggagcaaaccacaggaaggcttcataatccctgatggagagctggaactttgtcttgcaggcaacagggagcctccaaagggcttgggctggggagtgacagagctttgttatttagaaagatgactcagtggcagtaaggcgtcagcaagactgaaggcaggagtactagttaggagatccccacaggctttacactagagacagtaagggcctgcaggggtcagagctgcgaagctgagagatatgagaaaatgttacaaatacaggaagtgcaggactgtgccactagttatacaatgtggatctgtgaagacgagctccaagtttctggcttatgagtttccaggtggttatcactggaaatacagaaagaggtgggggtaaacaatgagctcagttttacatgcatcgagcttgaagtgcccatggaacttgtaccatgtggcaagtgccagcaggaacgtggatattgtgatatggagcttggagagataagctactgactcaaatcgtgagccaatataaaatgtgacatgaggccggacacggtggctcatgcctgtaatcccagcactttgggaggccgatgcgggctgatcacttgagtgattcgagagtcgagaggctggtcgggagttcgagaccagcctgaccaacatggagaaaccctatctctactaaaaacacaaaaaattagccgggtgtggtggcgcatgcctgtaatcccagctactcaggaggctgaggcaggagaatcacttgaacccgagaggcggaggttgcagtgagccgagatcacaccattgcactccagcctgggcaacaagagcaaaactccgtccc

SEQ ID NO: 6874 - DNA, 1736 bp, Homo sapiens
aaatcccagacgcccctcaaattggagagggacagatgggcgctgtggctcacgcccgtaatcacaaccctctgagaagccgaggcgggcggatcacgaggtcaaaagatcgagaccgtcctggccaacgtggtgaaaccccgtctctactaaaaataaaaaaattagctgggcgtggtggcgcgcgcctctagtcgggaggctgaggcaggagaatcgcttgaacccggaaggcggaggttgcagtgagccgagatcgcgccactgcaccccagcctggcaacagagcgagactctggctcaaaaaaaaaaaaaaaaaaaaaaaaaattggagagggacgctcttccgcctgcctgtacccggaagtgacgttatgtacgtccccccccgaggaagtgacgacaggcgtgcccttgacaggcagggagggctaggctgtgcatccctccgctcgcattgcagggagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtcttccctcccatacgcctttcatccctccttctagggcctatggcagttctcccaggatgtgtggcgagagcctgggccagcccacagcgttcctagtcaggcagccacaccttggtcctcatcttggtcccttccaatctgaaacctcgtgcctggctcgtctgccacctacatttctctttccagctgctgttttgtaaaaagaaaaagaaaaaagaagcccaaactagtgagagtaatatctaattatctcattttttgtaggtctgtgataaagaacttagtcatcccttccacctcctactgtgaagaacagaccctgggtcccacactgaaatcccctctagtcacccattcccaccccccagggagctgcctcccaggcagggggtgcagaaaatgattgatgggctggggaaccctggagagcctcgactccggaagtctcaaggtgcctcctcctctccttagctggcccgttggttttctgagcagggggctgaactgtgaacaagtcagacaaataaagcaagggtctgcaccatctgcaatgtca

SEQ ID NO: 6875 - DNA, 912 bp, Homo sapiens
agttcctccttgaattgttgcgtttcatcttttcagacgaccctgggttccagtgttggctgtcatttaatagcggggttactttgggcatgtcacttaacttacttgagcctcgtattccttcccttactcgcagtgtgggcagtacaatagcaacttcctggaagttgctgtaggaagaccaataatgtgtgtaagatggctcagcgacttcttctgaggaggttcctggcctctgtcatctccaggaagccctctcagggtcagtggccacccctcacttccagagccctgcagaccccacaatgcagtcctggtggcctgactgtaacacccaacccagcccggacaatatacaccacgaggatctccttgacaacctttaatatccaggatggacctgactttcaagaccgagtggtcaacagtgagacaccagtggttgtggatttccacgcacagtggtgtggaccctgcaagatcctggggccgaggttagagaagatggtggccaagcagcacgggaaggtggtgatggccaaggtggatattgatgaccacacagacctcgccattgagtatgaggtgtcagcggtgcccactgtgctggccatgaagaatggggacgtggtggacaagtttgtgggcatcaaggatgaggatcagttggaggccttcctgaagaagctgattggctgacaagcagggatgagtcctggttcccttgcccgcgtgggaccccaatagaactcagcccttccatgccagcccttcctgctgcctccctcctgtctggctcctggggcccatgcttagagcccaggctccagccctgagtgcttccgagctggcggactgcccaggggccatcagaggatggtggtgctgctgctgatccggggaccgctgtct

SEQ ID NO: 6876 - DNA, 3047 bp, Homo sapiens
gggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctag

SEQ ID NO: 6877 - DNA, 3128 bp, Homo sapiens
gggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagctctggaatcaacctcttctccaagggccctggtttcttttactggagaatggcatttagaaaccaagatctacgtgctagattacctaggaacagtacgatttggggttatcacaaataaacatcttgcgaaactggtatccttagtacactctggaagtgtgtatttacatagacatttcaacacatcacttgtcttccccagggaggtcctgaactacacagctgagaacatctgtaagtgggccttagaaaaccaggagacgctctttcggtggctgcggccacacggaggcaagagtctcctgctgaataacgagctgaagaaaggaccagcgctgtttctgttcataccttttaatcccctggccgaaagtcatcctttaatagacgagatcaccgaagtggccttggagtacaacaactgtcatggggaccaggtggtggagcgtctccttcagcacctgcggcgggtggatgctccagtgctggagtccctggccctggaagtgccggcacagctgccagacccgccaacgatcacagcgtccccctgctgcaacactgtggtgctgccccagtggcactccttctccaggacccacaacgtctgtgaactctgtgtcaaccagacctccgggggcatgaagccgagctcggtcagcgtgccacagtgcagcttttttgaaatggcagcagctctggattctttctacctcaaggagcagaccttttatcatgtggcatcagacagcatagaatgcagcaattttttaacttcctatagccccttcagctactacactgcatgttgcaggaccataagcaggggtgtgtcaggcttcatcgactctgaacaaggtgtctttgaagcccctactgttgcattttcttcccttgagaagaaatgtgaggttgatgccccaagctccgttcctcacattgaggagaacaggtatctctttccagaagtggacatgactagcacaaacttcacaggcctgagctgcagaaccaacaagactctcaacatctaccttttggattcaaatttgttttggttatatgcagagagactgggtgctccgagctccactcaggtgaaagaatttgcggcaattgttgacgtgaaagaagaatctcattacatcttggatccaaagcaagcactgatgaagctcaccctagagtcttttattcaaaacttcagcgttctctatagtcccttgaaaaggcatctcattggaagtggctctgcccagttcccgtctcagcatttaatcactgaagtgacaactgataccttttgggaagtagtccttcaaaaacaggacgttctcctgctctattacgctccgtggtgcggcttctgtccatccctcaatcacatcttcatccagctagctcggaacctgcccatggacacattcactgtggcaaggattgacgtgtctcagaatgaccttccttgggaatttatggtcgatcgtcttcctactgtcttgttttttccctgcaacagaaaggacctaagtgtgaaataccccgaagacgtccccatcacccttccaaacctgttgaggttcattttgcatcactcagaccctgcttccagcccccagaatgtggctaactctcctaccaaggagtgtcttcagagcgaggcagtcttacagcgggggcacatctcccacttggagagagagatccagaaactgagagcagaaataagcagcctccagcgagcacaagtgcaggtggagtcccagctctccagtgcccgcagagatgagcaccggctgcggcagcagcagcgggccctggaagagcagcacagcctgctccacgcacacagtgagcagctgcaggccctctatgagcagaagacacgtgagctgcaggagctggcccgcaagctgcaggagctggccgatgcctcagaaaacctccttaccgagaacacgtggctcaagatcctggtggcgaccatggagaggaaactggagggcagggatggagctgaaagcctggcggcccagagagaggtccaccccaagcagcctgagccctcagccaccccccagctccctggcagctcccctccacctgccaatgtcagcgccacactggtgtctgaaaggaataaggagaacaggacagactaactttttaaatgatatgaagaaatcagaggtgaaaattgtacattgggaatatatttatgcaaattttattgaaatttattgtaaataaagattttctcagtggtctag

SEQ ID NO: 6878 - DNA, 1712 bp, Homo sapiens
gtggagcgtccgggttagcgggtgcggcgagctgcgggattggggagcaacgggccgggccgggccttcgggcccgaggcggcggcggcggtataaagccggcgactgggagcatgtaatgtcggaatgcggaggccgcggcggcggcagcagcagcagcgaggacgccgaggacgagggagggggcggcggcggccccgcgggctcagactgcctcagctcgagcccgaccctggccacagcgtcctcggcgggccggctccgtcgcgggctgcgtggcgccttcctcatggcgcgccagcggccggagctgctctgcggggccgtggcgctcggctgcgcgctgctcctcgccctcaagttcacctgcagtcgagcaaaagatgtgataataccagcaaagccacctgtcagctttttctccttgaggtctccagtccttgacctcttccaggggcagctggattatgcagagtacgttcgacgggattcagaggtggtactgctcttcttctatgccccttggtgtggacagtccatcgctgccagggcagaaattgagcaagcagcaagtcggctttcagatcaggtgttgtttgtggcaattaactgttggtggaaccaggggaaatgcagaaaacagaaacacttcttttattttcctgtaatatatctgtatcatcggagttttggaccaatcgaatacaaaggccccatgagtgctgtttacattgagaagtttgtccgccgggtgatgaaaccacttctctacatcccatctcaatcagaattactagattttctctcaaactacgagcctggagtactcgggtactttgagttcagtggctcaccccagcctcctggttatttgaccttcttcacctcagcattacattcattaaagaaagatggagtctcgccctgccgcccaggctggagtgcagtggcgtgatcttggctcactggaatctgcctcccgggttcaagcgattctcctgcctcagcctcctgagtagctggagttacataggtgcctgccgccatgcctggctaatttttgtatttttagtagatatggggttttgccacgttggccaggctggtctcgaactcctgacgtcaggtgatccaccagcactttgggaggcttaggcgggtggattgcttgagtccaggagtttgagaccagcctggccaacatggcaaaactccgtctctacaaggaatacaaaaattaggcacgtgtggtggtacacacctgtaatcccagctagttgggaggctgaggtgggagacttgcttcaacgtaggaggcagaggttgcagtaaaccgagatcgcgccactgcaccactgcactccagcctgggggacagagtgagatcctgtctcaaaaaaaaaaaccatatatatatatatgatatgaatgtcgggcacggtggctcacgcctgtaatcccaacactttggaaggtcaaggcgggtggatcacctgaggtcaggagttcgagaacagtctggccaacatgacgaaaccccgtctctactaaaaatacaaaaatttagccagacatggtggcacgtgcttgtagtcccagctacttgggaggctgaggcaggagaatcgattgaacccgggaggcggaggttgcagtgagccaagatcacgccattgcactccagcctgggtgacagagcgagactctgtctc

SEQ ID NO: 6879 - DNA, 3548 bp, Homo sapiens
aggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaatcacttgaacccgggaggcagaggttgcagtgagctgagatcatgccactgcactccagcctgtgcaaccagagcgaaactccatctcaaaaacaaacaaaaagaagtattgaagtgtaaaacactgttcttgcccacaagttgattctagtctagttcaagacacatgtttagtaaagagacaacatgtaatttaaacaaactttttttttttttttagacaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttagtagagatggggttttgccatgttggccaggctggtctcaaactgctgacttcaggtgatccacccgcctcagcctcccaaagtgttgggattacaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtcca

SEQ ID NO: 6880 - DNA, 3641 bp, Homo sapiens
agttaaaaccaacctctcctgccctgagtggataggtagggttagggttgccagatgtcacgaagttacaggatgctcagttttaaggtatatcccttatactataagggttatagtaaaaaatattcattatgtgaaattcaaatataactgggtatcaggtattctatgtggcaaccctaggtaggggagcacaggttaggcaagcgattagaagatttgcagcctccaaagtttctgcacctcgatgggacactagaacaggaaggctcctgggcctttctggctctgggaatgaagcgtggaaaaccctccttaggcgggcgcagtgcttcaagtagccaagctctgacttccgagggaagaaaggaggccatgggcctctgccagagccatgctctgcactctggggtcagcagagttcaaaacgacctgcaacgtctggcgcttagctcctaaagaggtctccagtccagcgccgacggccagcggctagaggccgtccgcccgactccaagatggcgcccgccacagctgccaggtgttaagatggcggcgcggggccgcgcccgcgctcccaggctctcctcccccagccttcctccggctggcagcacgactcgcgtagccgtgcgccgattgcctctcggcctgggcaatggtcccggctgccggtcgacgaccgccccgcgtcatgcggctcctcggctggtggcaagtattgctgtgggtgctgggacttcccgtccgcggcgtggaggttgcagaggaaagtggtcgcttatggtcagaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagcaggaaagtatgtaaccagaattggttagtgtgaccccctcaagtagcaagtgatggaaaataagagtcaaataccttgatgtttgtgatctctaactcaaaaaatttgaagtgttttaagttgtttctgggtaagggagatgttaggagaaaggaaatgctgtaactaaagctcaattattatcagttctatgctaacgtatacattttaatcatagttacctaagcagcatgcattaattgaaccttaaaatgttcccagcaggctgggcgcagtggctcatgcctgtaatcccagcactttgggaggccaaggcgggaggatcacttgaggttaggacttttgagaccagcctggccaacttggtgaaaccctctctctactaaaaatacaaaaaattagctgggcgtggtggcgggcacctgtaatcccagctacttgggaaagctgaggcatgagaatcacttgaacccgggaggcagaggttgcagtgagctgagatcatgccactgcactccagcctgtgcaaccagagcgaaactccatctcaaaaacaaacaaaaagaagtattgaagtgtaaaacactgttcttgcccacaagttgattctagtctagttcaagacacatgtttagtaaagagacaacatgtaatttaaacaaactttttttttttttttagacaaagtctcactctgtcacctaggctggagtgcaatggtgcaatcttggctcactgcaacctctgcttcccgggttcaagcgattctccagcctcagcctcctgagtagctgggactatgggcctgtgccatcacacccagctaatttttctatttttagtagagatggggttttgccatgttggccaggctggtctcaaactgctgacttcaggtgatccacccgcctcagcctcccaaagtgttgggattacaggtgtgagccactgcgcctggcctaaacaaactttttgaaaagctgtttctaaaagattccttaaattcagatatgacagctaattacctcatcataaattacttttatactaattgtttccagggttttagagtagttgaatgtttatttcacaaggcaccctaaattctatagaaataaaacctcagatgagtctccttcttagagtgttacaatgaatgggagtttacaacttttatgtgtcatgtttccaacagctgtgtttggggtggtcactggcaggaggggaccgtatctcagaatggcacattatttctattttacacatgagcaaattgaggcatagagagttagataacttgcccaggttacacagattgtaagttgatgaagctgggatttgaatcttcacatgtgtgtacttataaatacaaatgtaaggaaaactctagtgagtccacctcttatattgagttattactgtgtgagtgccaagtactgttttagatgctttacatatactattttgtttaatatcctttttaaagaataaactaggttggtgcag

SEQ ID NO: 6881 - DNA, 1477 bp, Homo sapiens
ttttccctggggtgtcctggatggaggcaggacagcagagagttgtggagaaggttgcagaggaaagtggtcgcttatggtcagaggagcagcctgctcaccctctccaggtgggggctgtgtacctgggtgaggaggagctcctgcatgacccgatgggccaggacagggcagcagaagaggccaatgcggtgctggggctggacacccaaggcgatcacatggtgatgctgtctgtgattcctggggaagctgaggacaaagtgagttcagagcctagcggcgtcacctgtggtgctggaggagcggaggactcaaggtgcaacgtccgagagagccttttctctctggatggcgctggagcacacttccctgacagagaagaggagtattacacagagccagaagtggcggaatctgacgcagccccgacagaggactccaataacactgaaagtctgaaatccccaaaggtgaactgtgaggagagaaacattacaggattagaaaatttcactctgaaaattttaaatatgtcacaggaccttatggattttctgaacccaaacggtagtgactgtactctagtcctgttttacaccccgtggtgccgcttttctgccagtttggcccctcactttaactctctgccccgggcatttccagctcttcactttttggcactggatgcatctcagcacagcagcctttctaccaggtttggcaccgtagctgttcctaatattttattatttcaaggagctaaaccaatggccagatttaatcatacagatcgaacactggaaacactgaaaatcttcatttttaatcagacaggtatagaagccaagaagaatgtggtggtaactcaagccgaccaaataggccctcttcccagcactttgataaaaagtgtggactggttgcttgtattttccttattctttttaattagttttattatgtatgctaccattcgaactgagagtattcggtggctaattccaggacaagagcaggaacatgtggagtagtgatggtctgaaagaagttggaaagaggaacttcaatccttcgtttcagaaattagtgctacagtttcatacattttctccagtgacgtgttgacttgaaacttcaggcagattaaaagaatcatttgttgaacaactgaatgtataaaaaaattataaactggtgttttaactagtattgcaataagcaaatgcaaaaatattcaatagatgcactattcttgtttttactgcatgaacgtaatccagtatttggaaagtaatccagtttgaaatgtgaagatgtattccggcagaatagtgagtagaatgacatgcttactatacagaaggcaaaaataggactctcaggtaatagtttaaggaaacccttgattccttatatatgtttaagaaggttagttttctgtttctttgcagtttttcttctagagtccatagca

SEQ ID NO: 6882 - DNA, 2964 bp, Homo sapiens
ccggaggccgcggcgagagcgcgcccagccccgccgcgatgcccgcgcgcccaggacgcctcctcccgctgctggcccggccggcggccctgactgcgctgctgctgctgctgctgggccatggcggcggcgggcgctggggcgcccgggcccaggaggcggcggcggcggcggcggacgggccccccgcggcagacggcgaggacggacaggacccgcacagcaagcacctgtacacggccgacatgttcacgcacgggatccagagcgccgcgcacttcgtcatgttcttcgcgccctggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaa

SEQ ID NO: 6883 - DNA, 1301 bp, Homo sapiens
aattcaaccgcctcttgcacctcggcaccgagggaggggaaggtggggtcgtcgccctttcgggcagccgggagtccaaatgtcaccccgcggtccctgcccagcgccccaaacttcctgtgccggccggacgcgcggcctgcccgtgggccacgtgcactcaccagagcggccttgctgctgccgcggccaccggggtcggctgggacagactgcgggcacgtccccttccagaggctttaactgaaaaatagaacccaggaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttag

SEQ ID NO: 6884 - DNA, 2977 bp, Homo sapiens
atgactcagtctgtagactccaacagagggaacaggaacgaaaaaaggtgtggacactgccagcggctgcagccgacttggaatgacctgggagacaaatacaacagcatggaagatgccaaagtctatgtggctaaagtggactgcacggcccactccgacgtgtgctccgcccagggggtgcgaggataccccaccttaaagcttttcaagccaggccaagaagctgtgaagtaccagggtcctcgggacttccagacactggaaaactggatgctgcagacactgaacgaggagccagtgacaccagagccggaagtggaaccgcccagtgcccccgagctcaagcaagggctgtatgagctctcagcaagcaactttgagctgcacgttgcacaaggcgaccactttatcaagttcttcgctccgtggtgtggtcactgcaaagccctggctccaacctgggagcagctggctctgggccttgaacattccgaaactgtcaagattggcaaggttgattgtacacagcactatgaactctgctccggaaaccaggttcgtggctatcccactcttctctggttccgagatgggaaaaaggtggatcagtacaagggaaagcgggatttggagtcactgagggagtacgtggagtcgcagctgcagcgcacagagactggagcgacggagaccgtcacgccctcagaggccccggtgctggcagctgagcccgaggctgacaagggcactgtgttggcactcactgaaaataacttcgatgacaccattgcagaaggaataaccttcatcaagttttatgctccatggtgtggtcattgtaagactctggctcctacttgggaggaactctctaaaaaggaattccctggtctggcgggggtcaagatcgccgaagtagactgcactgctgaacggaatatctgcagcaagtattcggtacgaggctaccccacgttattgcttttccgaggagggaagaaagtcagtgagcacagtggaggcagagaccttgactcgttacaccgctttgtcctgagccaagcgaaagacgaactttaggaacacagttggaggtcacctctcctgcccagctcccgcaccctgcgtttaggagttcagtcccacagaggccactgggttcccagtggtggctgttcagaaagcagaacatactaagcgtgaggtatcttctttgtgtgtgtgttttccaagccaacacactctacagattctttattaagttaagtttctctaagtaaatgtgtaactcatggtcactgtgtaaacattttcagtggcgatatatcccctttgaccttctcttgatgaaatttacatggtttcctttgagactaaaatagcgttgagggaaatgaaattgctggactatttgtggctcctgagttgagtgattttggtgaaagaaagcacatccaaagcatagtttacctgcccacgagttctggaaaggtggccttgtggcagtattgacgttcctctgatcttaaggtcacagttgactcaatactgtgttggtccgtagcatggagcagattgaaatgcaaaaacccacacctctggaagataccttcacggccgctgctggagcttctgttgctgtgaatacttctctcagtgtgagaggttagccgtgatgaaagcagcgttacttctgaccgtgcctgagtaagagaatgctgatgccataactttatgtgtcgatacttgtcaaatcagttactgttcaggggatccttctgtttctcacggggtgaaacatgtctttagttcctcatgttaacacgaagccagagcccacatgaactgttggatgtcttccttagaaagggtaggcatggaaaattccacgaggctcattctcagtatctcattaactcattgaaagattccagttgtatttgtcacctggggtgacaagaccagacaggctttcccaggcctgggtatccagggaggctctgcagccctgctgaagggccctaactagagttctagagtttctgattctgtttctcagtagtccttttagaggcttgctatacttggtctgcttcaaggaggtcgaccttctaatgtatgaagaatgggatgcatttgatctcaagaccaaagacagatgtcagtgggctgctctggccctggtgtgcacggctgtggcagctgttgatgccagtgtcctctaactcatgctgtccttgtgattaaacacctctatctcccttgggaataagcacatacaggcttaagctctaagatagataggtgtttgtccttttaccatcgagctacttcccataataaccactttgcatccaacactcttcacccacctcccatacgcaaggggatgtggatacttggcccaaagtaactggtggtaggaatcttagaaacaagaccacttatactgtctgtctgaggcagaagataacagcagcatctcgaccagcctctgccttaaaggaaatctttattaatcacgtatggttcacagataattctttttttaaaaaaacccaacctcctagagaagcacaactgtcaagagtcttgtacacacaacttcagctttgcatcacgagtcttgtattccaagaaaatcaaagtggtacaatttgtttgtttacactatgatactttctaaataaactctttttttttaaaagtctggtctttccttcaatgttacagcaaaacagatataaaatagacaataaattatagtttatatttacaaaaaaagctgtaagtgcaaacagttgtagattataaatgtattatttaatcagtttagtatgaaattgccttcccagtacatgattgtgaaaaagacatttagaaaatattctaaaatttaatctgagcctcactttctacaagggaaatcatgatttccgttcataaacagcatgctcatccccctaacaccatt

SEQ ID NO: 6885 - DNA, 2490 bp, Homo sapiens
atgcgcattgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccgtacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcatt

SEQ ID NO: 6886 - DNA, 1631 bp, Homo sapiens
acggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatcactgtggagcaacatataggcaacattttcatgtttagtaaagtggccaacacaattcttttcttccgcttggatattcgcatgggcctactttacatcacactctgcatagtgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttga

SEQ ID NO: 6887 - DNA, 1521 bp, Homo sapiens
cgttacggccgaaaagatggcggtcttggcacctctaattgctctcgtgtattcggtgccgcgactttcacgatggctcgcccaaccttactaccttctgtcggccctgctctctgctgccttcctactcgtgaggaaactgccgccgctctgccacggtctgcccacccaacgcgaagacggtaacccgtgtgactttgactggagagaagtggagatcctgatgtttctcagtgccattgtgatgatgaagaaccgcagatccatgttcctgatgacgtgcaaaccccccctatatatgggccctgagtatatcaagtacttcaatgataaaaccattgatgaggaactagaacgggacaagagggtcacttggattgtggagttctttgccaattggtctaatgactgccaatcatttgcccctatctatgctgacctctcccttaaatacaactgtacagggctaaattttgggaaggtggatgttggacgctatactgatgttagtacgcggtacaaagtgagcacatcacccctcaccaagcaactccctaccctgatcctgttccaaggtggcaaggaggcaatgcggcggccacagattgacaagaaaggacgggctgtctcatggaccttctctgaggagaatgtgatccgagaatttaacttaaatgagctataccagcgggccaagaaactatcaaaggctggagacaatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttga

SEQ ID NO: 6888 - DNA, 4752 bp, Homo sapiens
ggtagccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaagtgaaaatgaaaaccaagaacagatagaagagagcaaagaacagcaggagcccagcagtggaggatctgtagtgcctacagtgcaggagcccaaggatgtattagaaaagaagaaagattgagacttgatgactataaaatatttgttaggacttcaaattattaaagagtctatttattgaatttagacatttaatcatgatctttacagaaaagaacatgttattcgtattttgctaatatcaactgcatggattaaagtagtccctccatacatggggaagtgtttggagcaaagagatgaacagtttgtctgaaacaaacacagagcactccatcaaaatttacctgatctttgtgattagaacagaacaattctatttgcatgtttctctatctgaatattctgtgacaaaaagttaagattcttgggcagaatatttaaattggtcagtcaggtagaagatacatgtgtgatatagaaaaataatgcctctcctgctgccatccgtttccctcatatattttggacaagatttatatggacaaaattaagtctttaaaatttaggcactttaaggagaactaataactttttccatgtatcaagattatgaggttaaaaataatgtggttttatatagcatagtggttttattttgttagttatttttaaaggagaagaaatgttactttttaactttatactcagttgcattatcataaaattttcatatatgcctagataatggggaaaaaaagtcttgtgattgactttcgcaaaataaacaggatttactgagtagaggtttcagcccattccttggaatactaacaggtatttcatcagtcattgtaggttgggaagggtctctgttaatcctactctgctttagccagaatagcctagtattttatttctattttatatattgagatttcttctaacatttcctttgataaaaatcttctgctttttgaaaagtggtatgtatcatatttttatgtttctggtgtgtgaactttatggtaacttctactctagaatacgtacgtatgcacccacagacacacacagtttattgacacatctattatgtaatgctgtagacctgtccgtgtctgcttcataaggagtaacgactgacattagcatgtccagtgacaagtcacatccggtgtaaaaaaaagagatcagccagttaccttctccattgtcttagttctgtcacccatttcgtcaagtgacctctcatcttctataaactaatacaggaattctttccaaagcaatgtctaaaaactcttttttttaaagtaacagtttggtatgtttattgtagataaattatttttgaggccttcattttagctaagtttagaatttatattaggcaactatgatttgagtggttattcattgagtaattttccactataaagaattttattgaacatttattaaaaaataatgtaatgcatggtcaaaaaatatgtaattcatggtctggacactgacgttgtttagggatttagtcatcaaggacagccctctgttgtttctaatgccgtactaatcaagactgtatggacacttgcatcttaagtactaaggaattactagtgattgttttattttatccatgtactcttttagtatttaataattaaatacctattcttagtgtttgacactccatatttcttttttttggaaatgaaacaaatatgcagtccaaaattcaggaactactagagtgaaatgatattaagtggaaaccagagataaatgctgttaatttaacaagtagattcttctccaaagaatgatgagtgattcttgggaagataaatgttaatgttcccaatagtcaagcttgttttgcagtagtgaaaagcttagatgagtacggatacctcatttgaaactcagcctagtaaggaagtgaaaacttagcagtcagtgacatggggaaatagttatagaaaatgtcactgaattttttcatatttataattagtcatttacatatttttgtcttgttgatcattacctgtaaatgaaagaccttaataggaaaaaaagagtaaagctcagtgtgaatgcaaacatccacaaaatatgatcttcgtttatattctgtgatgttgtttataaatgaatgcctcagttctctgctacccttttcacagctttgtactgtttgccttatattctatttgtgcttttaaagtgtgtctgttgggaaaacaaaatgtgtaggtggtttgtaagtgaataatttttatttcttcttgtattaaaattttgtttttttctctactttgggagatgtttatttacattgtcagactattcacaaaacagattctaaaatttgtttgctcgtatgctgttcccttcaatgtgatatcagagattactatgaatgttagtttcattccgtgaaacattacttccatataaagacagatctcttaataagtgaatctagtggaagaacataggtatcattctaattccatggtaaattttgtcatgattctatatgaataatggggtccttcaggaagttggaatttttgccttctcttttaattgcagtgaagttctctttataacttctaaaattcggaattctagatccttgcttttgcagaatttggtgctcagacaatatttaaggacatttcagcgagacaaagtgcatgtttttatcgagtaccctgtgcaccacattatatctggcaattctttttgtttcattatgtgcatcaatatttttctcagctactattacctgaaacttgtttaacatgtattagacctagaattttcattttctttctcacatagttgcttcctggtatctgatttagaaataacatttaaatgccaagtatctgggggattgaaggaagggtctatatgagcaggtgaattagcagtactgtttttgtttagtggatattgttagtgactttttgtgtgtgttttgctttgggacctttttattttggtgttgcaaaaagtaacatattttcatcattgcttcatacgacatggagttaggacagggaaaaatcattcaacactccttatgcattaaatgatcaaataaaccagtgtaggatattaagactatcaattggtgggattaggcttgacattttatttttataaatatatattttttctgaatgtgtctgagtccaagagtgggcaaaaaataattttctactttggactaatctatagaggtttttgaaagtctgcattactaacttgttgaattcatgatattctgcctatggcacaaattgtaaacctttgtttttctaaaataaagtaattgaaaacctgc

SEQ ID NO: 6889 - DNA, 913 bp, Homo sapiens
gggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatggtaagttccaaatctttaactcatgtaaaacattttaaaattaaaatgtctgttatacaacttaggtgtaaagattatgtaaatgcttctactgttcaatgagaataacagttctcatgacttgaatgcctgatgttttgggttttttttcacccttcaacttataattgttagttatttttattctgagctttacctacacaacattctttttgttgttgtttgttaaattatatgcgtttttgaggaataaattctatgtgatttttatacattacttt

SEQ ID NO: 6890 - DNA, 1398 bp, Homo sapiens
ggtagccccgcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaatgatgacatttggcttgtagatttttatgcgccatggtgtggccattgtaaaaagctggaaccaatttggaatgaagttggtcttgagatgaaaagcattggttctccagttaaggttggaaagatggatgctacttcctattctagcattgcttcagagtttggagttcgaggttatccaacaattaagctattaaaaggggacttggcatataattatagaggaccacgaacaaaagatgatattattgagtttgctcacagagtatctggggctctaattcggccacttccaagtcaacaaatgtttgaacatatgcagaagagacaccgtgtatttttcgtttatgtaggtggagaatcacctttgaaagagaaatacatagatgctgcttcagaattgattgtatatacatacttcttttctgcctcagaagaagtggttcctgagtatgtgacactaaaagagatgccagctgtgcttgttttcaaagatgaaacttactttgtttatgatgagtatgaagatggtgatctgtcatcatggatcaacagggaaaggtttcagaattaccttgctatggatggcttcctcttgtatgaacttggagacacaggaaagcttgtggctcttgcagttattgatgagaaaaatacatcagttgaacataccagattgaagtcaattattcaggaagttgcaagagattacagagacctcttccatagggattttcagtttggccacatggatggaaatgactacataaataccttgctgatggatgaattgacagtcccaactgtagttgtactgaatacttcaaaccagcaatatttcttgctagatagacagattaagaatgttgaagacatggtccagtttattaataacattttggatggcacagtagaagcccaaggaggtgatagcattttgcagagattgaaaagaatagtatttgatgccaaatctactattgtgtctatattcaagagctcaccactgatgggctgctttctctttggcctgccactgggtgtcatcagtatcatgtgctatggaatctacacagccgacacagatggaggttatatagaagaacgatatgaagtgtctaaaaaaaagaagaaa

SEQ ID NO: 6891 - DNA, 6169 bp, Homo sapiens
ggaggcgggagggggcgtggcctcgacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctcctggccgcctggatcgcggctgtggcggcgacggcaggccccgaggaggccgcgctgccgccggagcagagccgggtccagcccatgaccgcctccaactggacgctggtgatggagggcgagtggatgctgaaattttacgccccatggtgtccatcctgccagcagactgattcagaatgggaggcttttgcaaagaatggtgaaatacttcagatcagtgtggggaaggtagatgtcattcaagaaccaggtttgagtggccgcttctttgtcaccactctcccagcattttttcatgcaaaggatgggatattccgccgttatcgtggcccaggaatcttcgaagacctgcagaattatatcttagagaagaaatggcaatcagtcgagcctctgactggctggaaatccccggcttctctaacgatgtctggaatggctggtctttttagcatctctggcaagatatggcatcttcacaactatttcacagtgactcttggaattcctgcttggtgttcttatgtctttttcgtcatagccaccttggtttttggcctttttatgggtctggtcttggtggtaatatcagaatgtttctatgtgccacttccaaggcatttatctgagcgttctgagcagaatcggagatcagaggaggctcatagagctgaacagttgcaggatgcggaggaggaaaaagatgattcaaatgaagaagaaaacaaagacagccttgtagatgatgaagaagagaaagaagatcttggcgatgaggatgaagcagaggaagaagaggaggaggacaacttggctgctggtgtggatgaggagagaagtgaggccaatgatcaggggcccccaggagaggacggtgtgacccgggaggaagtagagcctgaggaggctgaagaaggcatctctgagcaaccctgcccagctgacacagaggtggtggaagactccttgaggcagcgtaaaagtcagcatgctgacaagggactgtagatttaatgatgcgttttcaagaatacacaccaaaacaatatgtcagcttccctttggcctgcagtttgtaccaaatccttaatttttcctgaatgagcaagcttctcttaaaagatgctctctagtcatttggtctcatggcagtaagcctcatgtatactaaggagagtcttccaggtgtgacaatcaggatatagaaaaacaaacgtagtgttgggatctgtttggagactgggatgggaacaagttcatttacttaggggtcagagagtctcgaccagaggaggccattcccagtcctaatcagcaccttccagagacaaggctgcaggccctgtgaaatgaaagccaagcaggagccttggctcctgagcatccccaaagtgtaacgtagaagccttgcatccttttcttgtgtaaagtatttatttttgtcaaattgcaggaaacatcaggcaccacagtgcatgaaaaatctttcacagctagaaattgaaagggccttgggtatagagagcagctcagaagtcatcccagccctctgaatctcctgtgctatgttttatttcttacctttaatttttccagcatttccaccatgggcattcaggctctccacactcttcactattatctcttggtcagaggactccaataacagccaggtttacatgaactgtgtttgttcattctgacctaaggggtttagataatcagtaaccataacccctgaagctgtgactgccaaacatctcaaatgaaatgttgtggccatcagagactcaaaaggaagtaaggattttacaagacagattaaaaaaaaattgttttgtccaaaatatagttgttgttgatttttttttaagttttctaagcaatatttttcaagccagaagtcctctaagtcttgccagtacaaggtagtcttgtgaagaaaagttgaatactgttttgttttcatctcaaggggttccctgggtcttgaactactttaataataactaaaaaaccacttctgattttccttcagtgatgtgcttttggtgaaagaattaatgaactccagtacctgaaagtgaaagatttgattttgtttccatcttctgtaatcttccaaagaattatatctttgtaaatctctcaatactcaatctactgtaagtacccagggaggctaatttccttaaaaaaaaaaaatctatccatctacttctctcttacctgatttatgtgttagaataaattcatgaaattcgattccaagcatacgaaagatgcctaaagttgattctatgctccttagatccagacagaataatgagtacaggtttatgaaattctaaaagtttctgtcgtctttaaaaaggaacgtgcagtatatttctatctggctgtttagataaccctttccttgtattaattgtgagcacggagctcactggtgggggaggttctgaaactctctgccctcctgtggttgaatgaagatgttgcaagacttgcacaaaggaggttattcttctgacagcatcaacttttagagatggttctttttcatctttccaattcagttacttgacagtctccttccccagtatgctgaagtttgttaagagtcaccagtaattgtgcttttcagacagtagtgcagcttcaaaatcgaggccatcactgggctgatgggctgggagaaccttgccatgtgcctgcctgtttcctgcccccttagtcactgcccatttcctgcccccttggtcgctgacacaccttcacccaaagtgccatggttctgatggtggcagttccatctccctgacatcaggaagcttttctcgatcagagcagagcggggcctgcctgccctcgtgtcactggatttctttctcttataatcagctgaaacagagttctcaaagaacagtaaactcaggttcagaggtattatggaataagaatggtttcatagtttggcttttctatataattcctccctctcaaactgaaatattcatttttttagtggagtatttgactagagagaaggtaaggcagaaatacagtctacactggcttttaaaaatgtaaagccaatttccaaccggaccccaaatagtacaggttgaacattccgttccaacaatccaaaaccccaaatgctccaaaatcttaaactttgagttccagcattccgtcagaagtggaaaattttacacctgacctcatttgacaggtggcagttacagtgcaatcaaaactttgttccatgcccaagattattaaaaatattggataaaattaccttcaagctatgttgtataaggtgtatataaaacaaatgaattttgtgtttagacttgggtctactcccaagatacctcattatatatatacaaaaatccccaaatccaaaaacatttgaaacacttctggtcccacacattttggataagggatatttgacctatatctaattatataataagaaaaatgtattttcttttttttttttttttgagatggagtttcactcttgttgtcgcccaggctgcaatggcacaatcttggcttactacaacctccgcctccctagttcaagggattctcctgcctcagcctcccaggtagctgggattacaggcatgtgccaccatgcctggctaattttgtatttttagtagagacggggtttcgccatgttggtcagactggtcttgaactcctgacctcaggtgatccgcccgcctcagcctcccaacgtgctgggattacaggtgtgagccaccgtacctggcagaaaatgtactttctttctcagaaatacttttaaaaaaaattgaagggtgaggagaaaaacatcttggagaagaggacccattaaaactttaaatatctgtgggaaccatttttcctgattttcccttttttaacatcatggcaaagatgggtttttttccaacaaaatttaatttaatatctttccacttgaagattttaggtttgttttcaatacttaatgaatataaaactaaaggagaaaagccaacctgaaataatttaaactttatatgaacatttcgataagagtttgtggattttttctgtagataatatatttgatccggaactcaagtgcatggaaacatgattttgatttttaaaatctaaaaaaaaaaaaaattaaaatcatgcttccctctattgcagtatcagttatttagtcacagaatggtattttatgtaaattaaaattaggtgaatgcaatgcaggtaactggttttggaatgggaatgtgcagtgctttatgtttggggagttggagcagggtatcttttcatcaattagaaggaaagtttgaaacttctgattacctttatgttggtttctcttattatttgtctcttgctagatctgctaaaccaacccagcttgctcagagatctcatattgaagcaacatacaggcaatccacatctttctttccctttgaagtatagtcattggatgggatgagggacagggcctgttgggttcacagggccttgcactgcatgggcacatacttaaaagctcttgtgcatggaatccctgtctgttagccacaggcctctttagctctatacattcaaaataactactgtagtagaaaatagataagcttcagctgagttggcttttgatagtggaaaaaaaacaaaatttgactttttatggccaaaattccttgttgacagctgtgatgttctaatatgatttgggaatatgtcagtctacagaacctgcatcctgtaaaaacacctttggggtagacgataaaagtcatttttaaggcaaatacttaccatgtgactttttattaccaaatgcatcagtagtggagctggtatgttgtttcataggatggaaacattagaagtccagagaaaaataaattttaaaaaaaggtggaaaagttacggcaaacctgagatttcagcataaaatctttagtatgaagtgagagaaagaagagggaggctggttctgttgctcgtatcaataggttatctgtgtccctcatcttggtgttacagtgttatttctgtcagtattatgaatatgtggttgacccatcctgtcaaatgtaccaacattttcgaaagaattcattcaaatctcttatgccaacagaaaagttccttcttgtttaatatctctttacctcagtcctacattttgattctctggaggagattttagcttgtcttaaaaagccaaatttggagtcatcaagcctgctgaacctgatggggcagctttttgaacagctttctggaagtaagaacttcagttgaaaagccctttgatcgcttcagcccgggacatgcccttcagatggcttattctcagtaaagctttatgtagactgtgacactgtatatgtgtgactcgtacaactttgacgtgtttctgaagtggtttaatcgtatttgttattagcttctttgtggaaatgcaatttttatactaaaaacattgcttatttgcaatgcaatatgttataaatttgttgtttatattactggtattagtcttagcctaatgaacctaattatttttctttctgtattctttgcttcctcaaatagcatctgcagcaattggaatgagaaatccagatatgtgtttcaagtagtacattgcctgaatcacaaatcacttgatcacagtattgtatataatccctgatcctatttgtttcattttattgtaaattcccatttgcatcaaaacctaatgatagtgattggtaagtaaaaacaaatggtgtattgcttttcatacaagtgttttcacaaaagccatttgcctaggcagcaaaaaatattaatttgttaaaaaaaattttccttcgtgtccatcctc

SEQ ID NO: 6892 - DNA, 2114 bp, Homo sapiens
gcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagcctcgccccccacccctctcccccctggggggccccgtaccctcggcattgcctaacggacccccgtccccccgctccggccgtgaccccttggccatactgagcgagatcagtaagtcggtcaaaccgaggctagcatccttccgcagccttcgaggcagccgtgggacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatggg

SEQ ID NO: 6893 - DNA, 2018 bp, Homo sapiens
gagtctccccggggagggcggcgggcggcgggcggcggggaccgggtgcggtggtggctgcggcggcggcggcgggagcagcatggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccattttgttttatacaaaaatgggaaaaaaaaaaaagaaattatataaa

SEQ ID NO: 6894 - DNA, 1920 bp, Homo sapiens
atggattggggcactgagctgtgggatcagttcgaggtgctcgagcgccacacgcagtgggggctggacctgttggacagatatgtaaagttcgtgaaagaacgcaccgaagtggaacaggcttacgccaaacaactgcggagcctggtgaaaaaatatctgcccaagagacctgccaaggatgatcctgagtccaaattcagccagcaacagtccttcgtacagattctccaggaggtgaatgactttgcaggccagcgggagctggtggctgagaacctcagtgtccgtgtatgtcttgagctgaccaagtactcacaagagatgaaacaggagaggaagatgcacttccaagaagggcggcgggcccagcagcagctggaaaatggctttaaacagctggagaatagtaagcgtaaatttgagcgggactgccgggaggcagagaaggcagcccagactgctgaacggctagaccaggatatcaacgccaccaaggctgatgtggagaaggccaagcagcaagcccaccttcggagtcacatggccgaagaaagcaaaaacgaatatgcggctcaactgcagcgcttcaaccgagaccaagcccacttctatttttcacagatgccccagatattcgataagctccaagacatggatgaacgcagggccacccgcctgggtgccgggtatgggctcctgtcggaggccgagctggaggtggtgcccataatagccaagtgcttggagggcatgaaggtggctgcaaatgctgtggatcccaagaacgactcccacgtccttatagagctgcacaagtcaggttttgcccgcccgggcgacgtggaattcgaggacttcagccagcccatgaaccgtgcaccctccgacagcagtctgggcaccccctcggatggacggcctgaactccgaggcccgggtcgcagccgcaccaagcgctggccttttggcaagaagaacaagacagtggtgaccgaggattttagccacttgcccccagagcagcagcgaaaacggcttcaacagcagttggaagaacgcagtcgtgaacttcagaaggaggttgaccagagggaagccctaaagaaaatgaaggatgtctatgagaagacacctcagatgggggaccccgccagcttggagccccagatcgctgaaaccctgagcaacattgaacggctgaaattggaagtgcagaagtatgaggcgtggctggcagaagctgaaagtcgagtccttagcaaccggggagacagcctgagccggcacgcccggcctcccgacccccccgctagcgccccgccagacagcagcagcaacagcgcatcacaggacaccaaggagagctctgaagagcctccctcagaagagagccaggacacccccatttacacggagtttgatgaggatttcgaggaggaacccacatcccccataggtcactgtgtggccatctaccactttgaagatctgggcccacccccacccccatcacagggtccagcgagggcactatctctatggccgagggtgaagacctcagtcttatggaagaagacaaaggggacggctggacccgggtcaggcggaaagagggaggcgagggctacgtgcccacctcctacctccgagtcacgctcaattgaaccctgccagagacgggaagaggggggctgtcggctgctgcttctgggccacggggagccccaggacctatgcactttatttctgaccccgtggcttcggctgagacctgtgtaacctgctgccccctccacccccaacccagtcctacctgtcacaccggacggacccgctgtgccttctaccatcgttccaccattgatgtacatactcatgttttacatcttttctttctgccgctcggctccggccatt

SEQ ID NO: 6895 - DNA, 2672 bp, Homo sapiens
gtgcttcttgcccatggcggcgccggcggcgggcccgaggcgggggctgggaacagctggcacccggtcggaccttggccgccaccgccccctggccctggctggccgcccgcgctcgctgcgccgaggttgccgagctcgctgggccgcgccggaaacggggcgaggcggggccgcggcaggaagtggccctgccgggcccgagcgcttccgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcacctggaaccgggtggtgctgctccacggtcctcctggcactggaaaaacatccctgtgtaaagcgttagcccagaaattgacaattagactttcaagcaggtaccgatatggccaattaattgaaataaacagccacagcctcttttctaagtggttttcggaaagtggcaagctggtaaccaagatgtttcagaagattcaggatttgattgatgataaagacgccctggtgttcgtgctgattgatgaggtggagagtctcacagccgcccgaaatgcctgcagggcgggcaccgagccatcagatgccatccgcgtggtcaatgctgtcttgacccaaattgatcagattaaaaggcattccaatgttgtgattctgaccacttctaacatcaccgagaagatcgacgtggccttcgtggacagggctgacatcaagcagtacattgggccaccctctgcagcagccatcttcaaaatctacctctcttgtttggaagaactgatgaagtgtcagatcatataccctcgccagcagctgctgaccctccgagagctagagatgattggcttcattgaaaacaacgtgtcaaaattgagccttcttttgaatgacatttcaaggaagagcgagggcctcagcggccgggtcctgagaaaactcccctttctggctcatgcgctgtatgtccaggcccccaccgtcaccatagaggggttcctccaggccctgtctctggcagtggacaagcagtttgaagagagaaagaagcttgcagcttacatctgatcctgggcttccccatctggtgcttttcccatggagaacacacaaccagtaagtgaggttgccccacacagccgtctcccagggaatcccttctgcaaaccaaacgttacttagactgcaagctagaaagccaccaaggccaggctttgttaaaagaagtgtattctatttatgttgttttaaaatgcatactgagagacaaacatcttgtcattttcactgtttgtaaaagataattcagattgtttgtctccttgtgaagaaccatcgaaacctgtttgttcccagcccacccccagtggatgggatgcataatgccagcaagttttgtttaacagcaaaaaaggaagattaatgcaggtgttatagaagccagaagagaaactgtgtcaccctaaagaagcatataatcatagcattaaaaatgcacacattactccaggtggaaggtggcaattgctttctgatatcagctcgtttgatttagtgcaaaaatgttttcaagactatttaatggatgtaaaaaagcctatttctacattataccaactgagaaaaaaatggtcggtaaagtgttctttcataataaataatcagacatggtcccatttgcaggaaaagtgcagactctgagtgttccagggaaacacatgctggacatcccttgtaacccggtatgggcgcccctgcattgctgggatgtttctgcccacggttttgtttgtgcaataacgttatcacatttctaatgaggattcacattaatataatataaaataaataggtcagttactggtctctttctccgaatgttatgttttgcttttatctcacagtaaaataaatataattaatggtttgcatgtgaaattcacttttgaaagaacatgttaccttaccttttgttttagaagttttcaagtattaaaatattttttagaattttcttgttttgattctaagtatctcttccaagtgcttttaattttactaaaaattactcacatgattacttaa

SEQ ID NO: 6896 - DNA, 736 bp, Homo sapiens
cgggtcaggaggtggtgcgcctcgcgcggcagattcgaagctagggcggggcccgcgggctgaggcagcggctgtggcggcgacgctgggcgtgaggtggcggcggccgcgccctggttgggtccccactgctctcgggggcgccatggacgaggccgtgggcgacctgaagcaggcgcttccctgtgtggccgagtcgccaacggtccacgtggaggtgcatcagcgcggcagcagcactgcaaagaaagaagacataaacctgagtgttagaaagctactcaacagacataatattgtgtttggtgattacacatggactgagtttgatgaaccttttttgaccagaaatgtgcagtctgtgtctattattgacacagaattaaaggttaaagactcacagcccatcgatttgagtgcatgcactgttgcacttcacattttccagctgaatgaagatggccccagcagtgaaaatctggaggaagagacagaaaacataattgcagcaaatcactgggttctacctgcagctgaattccatgggctttgggacagcttggtatacgatgtggaagtcaaatcccatctcctcgattatgtgatgacaactttactgttttcagacaagaacgtcaacagcaacctcatcaccatagaggggttcctccaggccctgtctctggcagtggacaagcagtttgaagagagaaagaagcttgcagcttacatctga

SEQ ID NO: 6897 - DNA, 1017 bp, Homo sapiens
ggctggcggccggcgggagaggcggccggcctggactggcccgagagggatcccggttcccagaacagacctaggaggcggcctcgagggcggacggcagggagggccagcatgccccgactgctgcaccccgccctgccgctgctcctgggcgccacgctgaccttccgggcgctccggcgcgcgctctgtcgcctgcccctacccgtgcacgtgcgcgccgaccccctgcgcacctggcgctggcacaacctgctcgtctccttcgctcactccattgtgtcggggatctgggcactgctgtgtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatggacactgggacttagccccaagcctgggtgtcctctgaggccagcctctccaccttctgagcctgcgcccacactattgaaaacactaatgaaagtactcctctgaa

SEQ ID NO: 6898 - DNA, 784 bp, Homo sapiens
ggcaaatcggaggtcttgcttgcccagcctccggggagccgggccgagggccgggactgtctgagggaggactgtgacagccgcccggccccaggagtttaagagccggcgggaagaggtggcgatgggttactcagcagttcccaagtgcccacctcgcgggcgcgggagggacagtgtatggcagactcctgacatgttagtggagattgagacggcgtggtcactttctggctatttgctcgtttgcttctctgcggggtatttcatccacgatacggtggacatcgtggctagcggacagacgcgagcctcttgggaataccttgtccatcacgtcatggccatgggtgccttcttctccggcatcttttggagcagctttgtcggtgggggtgtcttaacactactggtggaagtcagcaacatcttcctcaccattcgcatgatgatgaaaatcagtaatgcccaggatcatctcctctaccgggttaacaagtatgtgaacctggtcatgtactttctcttccgcctggcccctcaggcctacctcacccatttcttcttgcgttatgtgaaccagaggaccctgggcaccttcctgctgggtatcctgctcatgctggacgtgatgatcataatctacttttcccgcctcctccgctctgacttctgccctgagcatgtccccaagaagcaacacaaagacaagttcttgactgagtgaggggcacagagcctgggacaacaaaaacggacaaggccagaaacagcttcatatgga

SEQ ID NO: 6899 - DNA, 1250 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcac

SEQ ID NO: 6900 - DNA, 810 bp, Homo sapiens
gtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtaaggaaactgtcaccagagaggttaagggatttactgagtctagaggctttcctttattctgtgacatatttgttgttatcatctttgttttatggataggaaaattgtcacgagattaagagatttacccaaggacactcagctagtgacctcaatttgaacccaaattttctggctccagagatcatgctttatttactgtagtactctgcttctatattagcccttcactgagcaaatttaaagtttttgaatgctctgcctactagctagcaaagctaaccttatttcttccatgttgctacccacaaaagatgaaagagaagtcttcactgtggggttgatggtagatata

SEQ ID NO: 6901 - DNA, 1056 bp, Homo sapiens
atggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcaggtaagtttctcaatctagaatgtaaactacttttacattcaaaattgagttctgtgatctcctgttctatttaaaatgtttagtatacgaggaagcagagaagaatggttgtttccatttttcttcatgtactagatctaaggaatcctggtcatgtttccaactagcatttctcaaactgtgctctaccagttagtagttctcaaagacataagaagttcattaaaaaatatcccgtgctcaaatatgatttgtaaatgtgagttcaattgagttaaagaagtttctttactgaataagttctcaaaatctttttaatatatgttgtctctaagagggattgtggttatttttcaaacccgtttcttttcctcatagtcactgtcaccttgtcaattaccataaaagcattgataggattctgttatacatatgggcattgtggaagcagagacaagattttcttttgcactggacaggcactccatactagtattgtgttgtttgcaaattacagaaactgaaatccagctagcttaagct

SEQ ID NO: 6902 - DNA, 1252 bp, Homo sapiens
agcgggtgaagcacctgattgcctaaaccactcgtttccttcctccagcactcaaagattaaccttagctccttccaagggttcgtgggggaaaattcgcctcgagggactgggtacatgcatattttaaaagggtctcccaatgtgattccacgggctcacgggcagaagaacacgcgaagagacggaactggcctctatcctatgcgaggtccctttaagaacctcgccctgttgcccttctccctcccgctcctgggcggaggcggaagcggaagtggcgagaaagtgtcggtctccaagatggcggccgcctggccgtctggtccgtctgctccggaggccgtgacggccagactcgttggtgtcctgtggttcgtctcagtcactacaggaccctggggggctgttgccacctccgccgggggcgaggagtcgcttaagtgcgaggacctcaaagtgggacaatatatttgtaaagatccaaaaataaatgacgctacgcaagaaccagttaactgtacaaactacacagctcatgtttcctgttttccagcacccaacataacttgtaaggattccagtggcaatgaaacacattttactgggaacgaagttggttttttcaagcccatatcttgccgaaatgtaaatggctattcctacaaagtggcagtcgcattgtctctttttcttggatggttgggagcagatcgattttaccttggataccctgctttgggtttgttaaagttttgcactgtagggttttgtggaattgggagcctaattgatttcattcttatttcaatgcagattgttggaccttcagatggaagtagttacattatagattactatggaaccagacttacaagactgagtattactaatgaaacatttagaaaaacgcaattatatccataaatattttttaaaagaaacagatttgagcctccttgattttaatagagaacttctagtgtatggatttaaagatttctctttttcattcatataccattttatgagttctgtataattttttgtggtttttgttttgttgagttaaagtatattattgtgagatttatttaataggacttcctttgaaagctgtataatagtgtttctcgggcttctgtctctatgagagatagcttattactctgatactctttaatcttttacaaaggcaagttgccacttgtcatttttgtttctgaaaaataaaagtataacttattcacat

SEQ ID NO: 6903 - DNA, 1631 bp, Homo sapiens
agttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttgg

SEQ ID NO: 6904 - DNA, 3435 bp, Homo sapiens
ggcctgaccacgcagttcttgggtctgtgctgctggcctggggttgtggttgaggccgggtctccgctcctgtgcccgggaagatggtgctaggtggttgcccgaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 6905 - DNA, 3263 bp, Homo sapiens
ctacgcggaaaggcctgaccacgcagttcttgggtctgtgctgctggcctggggttgtggttgaggccgggtctccgctcctgtgcccgggaagatggtgctaggtggttgcccggttagttacttacttctgtgcggccaggcggctttgctgctggggaatttacttctgctgcattgtgtgtctcggagccactcgcaaaatgcgaccgctgagcctgagctcacatccgctggcgccgcccagccggagggccccgggggtgctgcgagctgggaatatggcgacccccactctccggtcatcctctgctcttacctacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 6906 - DNA, 3295 bp, Homo sapiens
ggggttgtggttgaggccgggtctccgctcctgtgcccgggaagatggtgctaggtggttgcccgaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaagctgaacaatgaaaatcttcagcagaaatagaaatggccgtggattgtaatacacactgaaattctgactttctgaatttaaatgtagaataaattttaccaacttggagtactgtatgagtattttcagtagggggaataaactcaaaattatatttgttttgcagaaacctagtcatttgaaatgagccatcctattaagccctcttttgtctccattatgttccagaggcagtatatgcagtgcaataattttttcattccacttatgttttgaaagccagcggcatcagatgtgtgagttgagctattcctcctggcagaattgtccaatctaaaaatcagcgtttaccagcccatgctaataaaattaagatttcatacaagtttctgtaaaactattcttcatgattagctctccctgtgggctgcagcagtcagaaagagataacagccacacctctgcattccccggtcaccaggaataaaaggaaatgttccagattgtaagtggttttaaaaactcagttctcatcgtttgcaatctaagttgaaagaactattaaatataaaatcaaaggtgggcaatgtggccaagtcaatggaagaggctttactcagaataacttacaaattctagaaacaaggtagaactcactcagtttacctaataataattgaatttaagaccaaatatcacagttgaaataacttccctggatacattctatcattttgtagctttcctaagaatttcttgctttatcattcctgattaatcactgtttttacattattaaaggtggcaattttctgtaaaaaatttaaaacagatgatcctattctgtcttgaaagttctgtaccacactgaccttaaccttgcttataacataacaattggtaaacttttaattcataatctttataccctaagatagtatttattaaatttttatgggtcatgaagaaactagaccctctccccagaaaaatctacatacacagaatttacatagaacttgggttcatctacacaatttatgcatgaaataaaattgtactggtaccctataaatttatacaaataaaagagtttaagggagttcaaggatgccatatgtatattttaaaaaaatttctaagggaagtctaaaaaacataaattataatattacccaaaataagatgctacttttcacctaaccaagtcctgcctcatttcacactttaacctcctaagtatattcataaccctaccaaaagttgttttctttaaaaaataagaaactttagggccagcgcaatggtgcaagcctgtaatccctgcactttgggaggccgaggcaggtgaatcctttaaggtcaggagttcgagaccagcctggccaacatggtgagacacactcccccacccccgcccagtctctagtaaaaatgcaaaaattagccgggcgtggtggcgtgcacctgtaatcccagctactcgggaggctgaggtaagagaatcacttgaactgaggaggcagagattgcagtgagccgagatcctgccactgcacttcagcctgggcaacagagtgagactctgaccaaaaaagaaattttgcagctccaaggcttgaagtcatttatgttgccaggggtaagagcttggttgaagggctaaaagactagaaactactgaagatgcccttcttactgtcagtaaagctgctggagacaaaagaagttgttctcgctgctagagtggtaatttgagaatcatcagtattcctatgtgacaatccaaaattactggttttcatttgacttgtaaatgacacccatcatccatctgcccacaaacctggccaaatgtgatacaacctgaaaacctgatggactaaaggagtactatttaacaattgattgcctttgcactttattcaggttgtttcttaaattttggtagacagatccatttgtatatgtgtgtgttatatctagtttatggctatagagaaggtttaaaatactacagtgtccttccctcaaggttaaattagaagctgcctgccttttagttgtttcttgcctttaataaaatgttatcagttcccccaga

SEQ ID NO: 6907 - DNA, 570 bp, Homo sapiens
agttcttgggtctgtgctgctggcctggggttgtggttgaggccgggtctccgctcctgtgcccgggaagatggtgctaggtggttgcccgaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaaggt

SEQ ID NO: 6908 - DNA, 549 bp, Homo sapiens
aaaccggcggtggcaaccagcactagtcggcccgccagtcatatccgccccgccccgtcggctgccgggcacgcccacctaggggggtcgacggatccgattggagaacgcattcggcgcaaaagaaggaggagcatgagacccagaagaggaatcgagaagcagaagcagagggcggagtagccccgcccgtctgctcgaccttttctagttggttggcggagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggat

SEQ ID NO: 6909 - DNA, 885 bp, Homo sapiens
ggatttctaaaccggcggtggcaaccagcactagtcggcccgccagtcatatccgccccgccccgtcggctgccgggcacgcccacctaggggggtcgacggatccgattggagaacgcattcggcgcaaaagaaggaggagcatgagacccagaagaggaatcgagaagcagaagcagagggcggagtagccccgcccgtctgctcgaccttttctagttggttggcggagaatcacgccattttttaacatctctttttgatcaaacaagaaaaggcatttgggaaatgcaaagaggactgagaatactttggcttaaattttgcccccagaatcttgttgtttgcctactgaagagatgaaaccatggcagaagtagaatccttatagaaacaggaccagaaacacctcccttctccaacaaaaggttcattttggtggctgtccgtttgacctgctgtgcttcagtttaattggcttggaaaggggtcagcagggtgaaaccgaaccccagaaaacttgatgaagaaatgtcttttgcccgttttgattacgtgcatgcaaacagcgatttgcaaagaccgtatgatgatgatcatgatcttactggtgaattacagacctgatgaatttatagaatgtgaagacccagtggatcatgttggaaatgcaactgcatcccaggaacttggttatggttgtctcaagttcggcggtcaggcctacagcgacgtggaacacacttcagtccagtgccatgccttagatggaattgagtgtgccagtcctaggacctttctacgagaaaataaaccttgtataaagtataccggacactacttcataaccactttactctactccttcttcctgggatgttttgg

SEQ ID NO: 6910 - DNA, 3491 bp, Homo sapiens
cggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttga

SEQ ID NO: 6911 - DNA, 3453 bp, Homo sapiens
aggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattgattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctt

SEQ ID NO: 6912 - DNA, 1659 bp, Homo sapiens
gacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctatgtcctctttggaatgtaacaataaaaataatttttgaaacatc

SEQ ID NO: 6913 - DNA, 1433 bp, Homo sapiens
gctgcaggctggaccaaggggaggcacatggggagctccacagggaggccacgcccacgagggcagctcacagaattagaaagccgacggggtgctgtggtcaggaggcgcgtgggcggcagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaag

SEQ ID NO: 6914 - DNA, 2083 bp, Homo sapiens
gtgcgcgaacggctccggcccgcacgggtcgccagaggcgactgtgtgacactcggagtttgctggggtctccgtgggcgggaggactttccagcgcaatggcgactccctaagccccgcagcttctgcgcccgggaaagatatccaagagatgcaaagctctactgggcccaggctgccaccccagaggcccccttccgtcccggggccggggctaggccaaggcgggcaccaggactgcccagcctcccggcccttcgcactggtaaccggttccggggcggatgctttttgcatctgacccggcgcgcccggtgacgccttcgcgtccagacggaagtgcgggcggaggatccccagccgggtcccaagcctgtgcctgagcctgagcctgagcctgagcccgagccgggagccggtcgcgggggctccgggctgtgggaccgctgggcccccagcgatggcgaccctgtggggaggccttcttcggcttggctccttgctcagcctgtcgtgcctggcgctttccgtgctgctgctggcgcagctgtcagacgccgccaagaatttcgaggatgtcagatgtaaatgtatctgccctccctataaagaaaattctgggcatatttataataagaacatatctcagaaagattgtgattgccttcatgttgtggagcccatgcctgtgcgggggcctgatgtagaagcatactgtctacgctgtgaatgcaaatatgaagaaagaagctctgtcacaatcaaggttaccattataatttatctctccattttgggccttctacttctgtacatggtatatcttactctggttgagcccatactgaagaggcgcctctttggacatgcacagttgatacagagtgatgatgatattggggatcaccagccttttgcaaatgcacacgatgtgctagcccgctcccgcagtcgagccaacgtgctgaacaaggtagaatatgcacagcagcgctggaagcttcaagtccaagagcagcgaaagtctgtctttgaccggcatgttgtcctcagctaattgggaattgaattcaaggtgactagaaagaaacaggcagacaactggaaagaactgactgggttttgctgggtttcattttaataccttgttgatttcaccaactgttgctggaagattcaaaactggaagcaaaaacttgcttgatttttttttcttgttaacgtaataatagagacatttttaaaagcacacagctcaaagtcagccaataagtcttttcctatttgtgacttttactaataaaaataaatctgcctgtaaattatcttgaagtcctttacctggaacaagcactctctttttcaccacatagttttaacttgactttcaagataattttcagggtttttgttgttgttgttttttgtttgtttgttttggtgggagaggggagggatgcctgggaagtggttaacaacttttttcaagtcactttactaaacaaacttttgtaaatagaccttaccttctattttcgagtttcatttatattttgcagtgtagccagcctcatcaaagagctgacttactcatttgacttttgcactgactgtattatctgggtatctgctgtgtctgcacttcatggtaaacgggatctaaaatgcctggtggcttttcacaaaaagcagattttcttcatgtactgtgatgtctgatgcaatgcatcctagaacaaactggccatttgctagtttactctaaagactaaacatagtcttggtgtgtgtggtcttactcatcttctagtacctttaaggacaaatcctaaggacttggacacttgcaataaagaaattttattttaaacccaagcctccctggattgataatatatacacatttgtcagcatttccggtcgtggtgagaggcagctgtttgagctccaatgtgtgcagctttgaactagggctggggttgtgggtgcctcttctgaaaggtctaaccattattggataactggcttttttcttcctatgtcctctttggaatgtaacaataaaaataatttttgaaacatc

SEQ ID NO: 6915 - DNA, 318 bp, Homo sapiens
atgtatagaccagtcatggcttcctgtacatctgtgtcactatggatgattgcccttcttgtgtttggagtgttggcaatctttggaataactattggtctccttgttcattttctggcagtagcaaacaggatctacttctaccaaggtagctttaaaatgctggatatcccatataatagcaattatgaaagggagacatcaccagaaaataactatcttagccaaattcttgagactagatggttgatgcatttcaaagttctagcatttacagacaatatatcttttctcaagtcatcacactggtgtaagtaa

SEQ ID NO: 6916 - DNA, 2885 bp, Homo sapiens
cgcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatcgggctttgtgtggaagacggtccctgccactgccctctgccgatgaaatgcgggaagtgtatggcctagatgtttcataaggctggagtccctggtcagccccaccagattagtgcttctaccctaggcagggctttcttggtctaatggtaataagcaccgacactgctaagcactttacgtgcattattatttcattgaaaagaactgtcaagtgaaatactttttagcacagtaactggctttgtgggctctagagaagagttaatgaggcagtgcatgttcttggcccagagtaagtgcttagtgaatgctttctaactccgaaccccagccacatccagggactgggtgttgagcaaaaggggccttcaagatgttcaaggcacttggattttctcctgtctctcatcggcttttcttaacgggcctcagtgggtgcatgtgattatccacgtttcacctatgaaacatgaacagaggagactgacttatcagtgattcttccgcgggttcggacagggcctcgattctgttttaaactccagtagtccctagaaattgtagctccctctagttgtggcaataggtgtgggtccttgtgcttgcttttggcaagtttctgagctacacagggcctccattaccgtcactggtgaaatgcggctcacctcccagatttgttgtaaagattaaatgaactggtcagca

SEQ ID NO: 6917 - DNA, 683 bp, Homo sapiens
gctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttgg

SEQ ID NO: 6918 - DNA, 599 bp, Homo sapiens
gctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttgg

SEQ ID NO: 6919 - DNA, 530 bp, Homo sapiens
gctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttgg

SEQ ID NO: 6920 - DNA, 631 bp, Homo sapiens
cgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagttcccccatccctacccccagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgat

SEQ ID NO: 6921 - DNA, 1457 bp, Homo sapiens
gctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagggtatgtgcccccaggagagtgtctactgtgagaataagtgtggtgcccgcatgatgcggcggctgctggcccagcatgccacctctgagtgccccaagcgcactcagccctgcacctactgcactaaggagttcgtctttgacaccatccagagccaccagtaccagtgcccaaggctgcctgttgcctgccccaaccaatgtggtgtgggcactgtggctcgggaggacctgccaggccatctgaaggacagctgtaacaccgccctggtgctctgcccattcaaagactccggctgcaagcacaggtgccctaagctggcaatggcacggcatgtggaggagagtgtgaagccacatctggccatgatgtgtgccctggtgagccggcaacggcaggagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagca

SEQ ID NO: 6922 - DNA, 689 bp, Homo sapiens
gcccggagccgggagcgccgctccagcgaggcgcgggctgtggggccgccgcgtgcctggccccgctcgcccgtgccggccgctcgcccgccatgcctggcttcgactacaagttcctggagaagcccaagcgacggctgctgtgcccactgtgcgggaagcccatgcgcgagcctgtgcaggtttccacctgcggccaccgtttctgcgatacctgcctgcaggagttcctcagtgaaggagtcttcaagtgccctgaggaccagcttcctctggactatgccaagatctacccagacccggagctggaagtacaagtattgggcctgcctatccgctgcatccacagtgaggagggctgccgctggagtgggccactacgtcatctacagggccacctgaatacctgcagcttcaatgtcattccctgccctaatcgctgccccatgaagctgagccgccgtgatctacctgcacacttgcagcatgactgccccaagcggcgcctcaagtgcgagttttgtggctgtgacttcagtggggaggcctatgagagccatgagagttctctgggctttggttatcccaagttcatctcccaccaggacattcgaaagcgaaactatgtgcgggatgatgcagtcttcatccgtgctgctgttgaactgccccggaagatcctcagctga

SEQ ID NO: 6923 - DNA, 3958 bp, Homo sapiens
cgcacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaaattgtttttcaacattaatactattatttggcagtaatccagattgcttttgccaccaacctgaagacatatagaggcagaaggacaggaataattctatttgtttcctgttttgaaacttccatctgtaaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaatggaaaacatcctcatggccacaaaataaggtctaattcaataaattatagtacattaatgtaatataatattacatgccactaaaaagaataaggtagctgtatatttcctggtatggaaaaaacatattaatatgttataaactattaggttggtgcaaaactaattgtggtttttgccattgaaatggcattgaaataaaagtgtaaagaaatctataccagatgtagtaacagtggtttgggtctgggaggttggattacagggagcatttgatttctatgttgtgtatttctataatgtttgaattgtttagaatgaatctgtatttcttttataagtagaaaaaaaataaagatagtttttacagcct

SEQ ID NO: 6924 - DNA, 3059 bp, Homo sapiens
gaatcatccacgcacctgcagctctgctgagagagtgcaagccgtgggggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctc

SEQ ID NO: 6925 - DNA, 3462 bp, Homo sapiens
gcttttgccaccaacctgaagacatatagaggcagaaggacaggaataattctatttgtttcctgttttgaaacttccatctgtaaggtaagtgttgaaagtcagatattggctccagggactttctatatccacaaatacaaaaattgaggggtaactccttgatatcaagtcaaaggctcacaatgtctggtaataaaacaaattactttcaattttcttgaaatcttcaggctatcaaaaggagatgtgagagagggtattgagtctggcctgacaatgcagttcttaaaccaaaggtccattatgcttctcctctctgagaatcctgacttacctcaacaacggagacatggcacagtagccagcttggagacttctcagccaatgctctgagatcaagtcgaagacccaatatacagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggaccacatacactgttgggatgtacattgatacaacctttatgatggcaatttgacaatatttattaaaataaaaaatggttattcccttcatatcagtttctagaaggatttctaagaatgtatcctatagaaacaccttcacaagtttataagggcttatggaaaaaggtgttcatcccaggattgtttataatcatgaaaaatgtggccaggtgcagtggctcactcttgtaatcccagcactatgggaggccaaggtgggtgacccacgaggtcaagagatggagaccatcctggccaacatggtgaaaccctgtctctactaaaaatacaaaaattagctgggcgtgatggtgcacgcctgtagtcccagctacttgggaggctgaggcaggagaatcgcttgaacccgggaggtggcagttgcagtgagctgagatcgagccactgcactccagcctggtgacagagcgagactccatctcaaaaaaaagaaaaaaaaaaaagaaaaaaa

SEQ ID NO: 6926 - DNA, 2616 bp, Homo sapiens
tgcttttgccaccaacctgaagacatatagaggcagaaggacaggaataattctatttgtttcctgttttgaaacttccatctgtaagggttttgagctcatcttcatcattcatatgaggaaataagtggtaaaatccttggaaatacaatgagactcatcagaaacatttacatattttgtagtattgttatgacagcagagggtgatgctccagagctgccagaagaaagggaactgatgaccaactgctccaacatgtctctaagaaaggttcccgcagacttgaccccagccacaacgacactggatttatcctataacctcctttttcaactccagagttcagattttcattctgtctccaaactgagagttttgattctatgccataacagaattcaacagctggatctcaaaacctttgaattcaacaaggagttaagatatttagatttgtctaataacagactgaagagtgtaacttggtatttactggcaggtctcaggtatttagatctttcttttaatgactttgacaccatgcctatctgtgaggaagctggcaacatgtcacacctggaaatcctaggtttgagtggggcaaaaatacaaaaatcagatttccagaaaattgctcatctgcatctaaatactgtcttcttaggattcagaactcttcctcattatgaagaaggtagcctgcccatcttaaacacaacaaaactgcacattgttttaccaatggacacaaatttctgggttcttttgcgtgatggaatcaagacttcaaaaatattagaaatgacaaatatagatggcaaaagccaatttgtaagttatgaaatgcaacgaaatcttagtttagaaaatgctaagacatcggttctattgcttaataaagttgatttactctgggacgaccttttccttatcttacaatttgtttggcatacatcagtggaacactttcagatccgaaatgtgacttttggtggtaaggcttatcttgaccacaattcatttgactactcaaatactgtaatgagaactataaaattggagcatgtacatttcagagtgttttacattcaacaggataaaatctatttgcttttgaccaaaatggacatagaaaacctgacaatatcaaatgcacaaatgccacacatgcttttcccgaattatcctacgaaattccaatatttaaattttgccaataatatcttaacagacgagttgtttaaaagaactatccaactgcctcacttgaaaactctcattttgaatggcaataaactggagacactttctttagtaagttgctttgctaacaacacacccttggaacacttggatctgagtcaaaatctattacaacataaaaatgatgaaaattgctcatggccagaaactgtggtcaatatgaatctgtcatacaataaattgtctgattctgtcttcaggtgcttgcccaaaagtattcaaatacttgacctaaataataaccaaatccaaactgtacctaaagagactattcatctgatggccttacgagaactaaatattgcatttaattttctaactgatctccctggatgcagtcatttcagtagactttcagttctgaacattgaaatgaacttcattctcagcccatctctggattttgttcagagctgccaggaagttaaaactctaaatgcgggaagaaatccattccggtgtacctgtgaattaaaaaatttcattcagcttgaaacatattcagaggtcatgatggttggatggtcagattcatacacctgtgaataccctttaaacctaaggggaactaggttaaaagacgttcatctccacgaattatcttgcaacacagctctgttgattgtcaccattgtggttattatgctagttctggggttggctgtggccttctgctgtctccactttgatctgccctggtatctcaggatgctaggtcaatgcacacaaacatggcacagggttaggaaaacaacccaagaacaactcaagagaaatgtccgattccacgcatttatttcatacagtgaacatgattctctgtgggtgaagaatgaattgatccccaatctagagaaggaagatggttctatcttgatttgcctttatgaaagctactttgaccctggcaaaagcattagtgaaaatattgtaagcttcattgagaaaagctataagtccatctttgttttgtctcccaactttgtccagaatgagtggtgccattatgaattctactttgcccaccacaatctcttccatgaaaattctgatcatataattcttatcttactggaacccattccattctattgcattcccaccaggtatcataaactgaaagctctcctggaaaaaaaagcatacttggaatggcccaaggataggcgtaaatgtgggcttttctgggcaaaccttcgagctgctattaatgttaatgtattagccaccagagaaatgtatgaactgcagacattcacagagttaaatgaagagtctcgaggttctacaatctctctgatgagaacagattgtctataaaatcccacagtccttgggaagttggggacc

SEQ ID NO: 6927 - DNA, 3509 bp, Homo sapiens
cctcgtcccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattctttactcttga

SEQ ID NO: 6928 - DNA, 3049 bp, Homo sapiens
acattaacccctgactcacagctggaccgccccggcccgcagcgccacgtcccgggtggggcctgccacggcaaagcagcagtccggcctcgagcggcccctcgggggcggcggggtgggcgccaacagcagtcaggcctgacaagcggcgacctccaagggtgaggcctctgcgggcccccgactcacgcgcgtccgggctctgcaagcgcggtggggagcaggctgctgtggtcgcggggactgggttgcggcgcgccgcgtacgggacggccccaaactctcgacgcccggggcaagacgcccaccccctgggcgctctcgctgggccagaaaggaagacagaaaagccgcgggctgactgtggtggcgctcgcctgcagattgaaaagaaatgctgagaaatacataaagttttcctcttctgccttggatatttataatgggtatcgggaagtctaaaataaattcctgccctctttctctctcttggggtaaaaggcacagtgtggatacaagtccaggatatcatgagtcagattccaagaagtctgaagatctatccttgtgtaatgttgctgagcacagcaatacaacagaggggccaacaggaaagcaggagggagctcagagcgtggaagagatgtttgaagaagaagctgaagaagaggtgttcctcaaatttgtgatattgcatgcagaagatgacacagatgaagccctcagagtccagaatctgctacaagatgactttggtatcaaacccggaataatctttgctgagatgccatgtggcagacagcatttacagaatttagatgatgctgtaaatgggtctgcatggacaatcttattactgactgaaaactttttaagagatacttggtgtaatttccagttctatacgtccctaatgaactccgttaacaggcagcataaatacaactctgttatacccatgcggcccctgaacaatccccttccccgagaaaggactccctttgccctccaaaccatcaatgccttagaggaagaaagtcgtggatttcctacacaagtagaaagaatttttcaggagtctgtgtataagacacaacaaactatatggaaagagacaagaaatatggtacaaagacaatttattgcctgagatgaaacatataacatgtggctggctcttgttttgtaaaccaaatgattaatcttcacttgagaaagcagtttctaggaaatgtttaaataaaagagagtcttcaccttaaagaaacctatggagcacaagaaagataaatttctgcaggacagcctataaaattgtggtactttttgatgtttcagtaaacttgacattgtcagagtttcaaggacttttctttcacaattttcctagttcatggatatgaaaaaggaattctcaatccatattccttgtattgaaccttgaacaaaaacttgtatgacagacatttttaaaaatgtgacaacacttttattctctgaattttgatctcaaaggacacagaaaaaaaatggccccaggagatctgatcacacttcctcctgaggcacctctcatggatgttgcaataagcattcgggtactatcacccagaaatatgaattgccagaatagaacatttagcatgttaagcgttgatgcatataaaatcagaaatagatgtgagaatggtggaactttttaaaagaacccagtcaaatgtattttctgctgaaatctgcatatttggaggcatttcccaccaccgattcacagcccatttgatagtgtggtagttagggacttcgtggagtggtgttcagacgtcccctggggcttaaatctcttcatattagtcatcatttgtaactatggctttatttgcagagcttctaaaaggcgtataactgtgtgagtggccagatattcactttttaaatcaaaaacctctcttatggaagctttaaaagtttccgtcacacacaattctcttctcaggaagtatttctcatttaggtcttcaaagtagcctgactgtgtgcatgtgtgtgtgtgataggttatttataaagactttggatagaaggagatgtattttattacctcctattctagagccccatgctcctaacaagccagagaggccccaaacaggattgtttctttcctccacagcccttctgcccatctgagattgagggagcatcgtccacttgagatcagggatggggtggagaatgggtcatgtcatgtaatgagaaaagccctcttcgggatcatgagacttggttctagtccaatttctgccactgaggatgaatgtaactgtgggcaaactatttaccctcctttatctgtgaaatgaaagggttgaattgatggatctctaaaggcttttgtcctctatgaggatgtgaaaaactagggaccacaaaagggaacaagcaaaaaagtttggattcgataaagtgatatgtaatagttgcagaaggctttatatatgcttataatgaaaagatattttttgtatattgacagcataatttatttttaatgctgtcattacacttaaagtcacaggaaaaaaatatacatgcttactcaggctttcttaaaaataaatttttatagagatccttgagtaaagacattttgcttaatttcttttttcttattccccacttgtatatcccctaccagtaccgggatctgcacacatctttttgcagttacctcttcatagccatgaaccaaaacgttctatgaggagcatgcaagtaagtcaagcctcctattctgttagtacttattagaggaggagatggttttcattgcatagtgacattttcttagccttaacgttctgatagtagcttactactcacttctctttttcagttttcataataagtattcatttttttgccataatgcttcctgtaaagccaattttatatactaataaaacatgaactgcccactcttcatgcctgccaaacttggggcaattgatgctaaatggtatttttaaaataaatgtttttattcttt

SEQ ID NO: 6929 - DNA, 1355 bp, Homo sapiens
actgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagtaaaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataa

SEQ ID NO: 6930 - DNA, 2102 bp, Homo sapiens
caccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaagaggatgaagcatcttcccaaactgatttaagccaaacgatctcaaagaaaactgtcaggagcatacaagaggctccagtgagtgaagatcttgtaatcaggttacgtcgaccccctctaagatacccaagatatgaagccaccagtgtccaacagaaggtcaatttctctgaagaaggagaaactgaagaagatgatcaagacagctctcacagcagtgtcactactgttaaggccagatccagggattctgatgaatctggagataaaaccaccagatcatctagtcaatatatagaatcattttggcagtcatcacaaagtcaaaacttcacagctcatgataagcaaccttcagtgctaagctcaggatatcaaaaaactccccaggaatgggccccacaaactgcaagaataaggaccaggatgcaaaatgacagcattctgaaatcagagcttggaaaccagtcaccatcaacctccagccgacaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacct

SEQ ID NO: 6931 - DNA, 7905 bp, Homo sapiens
gggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgagtcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagaggactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggtaaagaacccttggatccagatcccagccattctccaagtgacaaggtaggaagagcagatgcacacttagggagcagctctgtggccctccctaaggaagcgagtgacggaactggagcatctcaggaaccacctactacagactcccaggaggcccagagtcctggtcattccagtgcagggcaagagggtgaggatacactgaggaggcgactgctggccccagaggctggaagtcatccacaacaaacacaaaaattggaagaaattaaagagaatgcacaggacaccatgagacagattaataaaaagggtttttggagctatggccctgtgattcttgtcgtcctggttgtggctgttgtggcaagttctgtgaatagctactattcctctccagcccagcaagtgcccaaaaatccagctttggaggcctttttggcccagtttagccaattggaagataaatttccaggccagagttccttcctgtggcagagaggacggaagtttctccagaagcacctcaatgcttccaaccccactgagccagccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgattttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgtcaaggaaccagtatgtcgcatattcttgtttcttcattcagttgaatatggtttttcatcatttctcttcaaaataatttagaaaaataaatttctaaagtcataatttttaatttagcctttttaaaaacattttcccttccatgtatagtgcaatcaattgagggtgttgtcagttttctgtctgctatttcaaaagtcttttttttttttttttttttttgagatggagtctcactctgactcccaggctgcagtgctgtggcttgatcatagctcactgtagctttaaactcctgggctcaagcaatcctcccaccttagcctcctgagtagccgggactacaagtgcagactaccacaccactctaccacactattttgtatagagacagggtcttactgtgttgcctaggctggtcttgaactcctggcctcaagtgatcctcccacctcagcgtcccaaagtgtttggattacagatgtgacccaatgcacccaaccaaacttcttttttttttttttttttttttgagagaaggtcttgctctgtcacccaggctggaatgcagtgcagtggcacaatctcatctcactgtaacctacacctcctgggttcaagtgattcttgtgcctcagcctcccaagtagctgggattacaggcatgcaccacaatgcccagctaattattgtatttttaatagagacgaggttttgctatgttgtccaggttggtctcgaactcctggcctcaattgatccgcctgccttggtctttcaaagtgctaggattataggcacgagccactgcacctggcctcaaaaatcatttttaaaagaagcagtatattagctctgggtcttctcatgactaaaatgactatttttaaacataagaccatattttataaatgtacagataattcaaatctattatctaatgtattaggttaatttctatttgttctatacttttttttttttttttttttttgagatggagtcttgctctgttgcccaggctggagtgcagtggtgcaatcttggctcactgcaagctccgcctcctgggttcatgccattctcctgcctcggccttccaagtagctgggactacaggtgcccgccccgacacctggctaatttttaaaaaaatatttttagtagagacagggtttcaccgtgttagccaggatggtctcgatctcctgacctcgtgatccgcccgctttggcctcccaaagtgctgggattacaggcgtgagccaccgcacccggcctattgacattttttaaggtttcagattttcttttgtgtgtctagtaattcgtcttttattgtcaaagataatttgcttatttgacttagaaaaatgatttgtgggcatacaatattgtatgtggtacctaaacgttgccatttagttactcttacagaacaactttcattacactgtatattaatataaattacttcttgagtaatcccagaattgtagaaccaattggtagaatcagaaactgtctttggacttgaggtttttcttcccttagggtaaattttaggttttctggttagtttccaggagttggcggacaagttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgactggcctacacagcttttaattgcttgatttatactttattaaagagaggaagcacaatgagcagtgatactaaaatataactaatatggcatgtgaaagtgatcattattcagatgatcttcaccaacactgcatttgcatatatctgaccaaactttatgcgacataggcaggtctctggcacttcaaaaatgaatgttaaatagaaaataataaataatagctgattagggtaatcatttatttaatcagaataaagattatatccataaaatttacttgcagagaagtactttctttttgttttaaagacagggtctcactctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttctttattattattattattattattattatagtttaagttctgggatacatgtggagaacatgcaggtttgttaacataggtatacacgtgccatggtggtttgctgcacccatcaacccgtcatctacattaggtatttctcctaatgctatccctcccccagccccccaccccctgacaggccccagtgtgtgatgttccctgccctgtgtccaagtgttttctttgttcaattcccacctatgagtgagaacatgcgatgtttggtaaactgtgctataacttctgtatctctataggccaatccaaatggcctgagaacataatcagtatcccctaatctgcaaaaaggtaaataccttagtcttcagtacctttccttccagtattatctgcattatctgtgcccgcttgctgtgatgtcttgaaaagcccataaattggttcttattttggcaaatggtctcctgcttttcctcactgaggcttataaactaaatttgcctttggctaagcgcagttacatgaaccaaaaagaacattttagacttgggaagcaacaggctgagtcacattgtatggggcagagttggccaagcccccggcagtcacagccctactctctgtgttccttctaggcctgaggacgcatcaacacaaagctccaggcagttgctcctggttcatcagagagcacaggaaatttaaatctatttgcctttcctgtcataaaagaaacagcacactgactttcaaactcaattgcattttgcttatttgtgcttaacaaaaaatatgtgtgctttgccaatactaacgtcccacttctctgcactccctttctgtataacagggattgcttttgtatttgtttcttatagatgctgatgatgtgccttattcagattagttggccattaccagaataaagaataaatctgaatttttttca

SEQ ID NO: 6932 - DNA, 1147 bp, Homo sapiens
tccagtggagaaggtggccagttctcagacagaggaagagtagaaatcataaatgagagctgtcttcatccaaggtgctgaagagcaccctgcggcattctgctaccaggtgaatgggtcttgccccaggacagtacatactctgggcatccagttggtcatctacctggcctgtgcagcaggcatgctgattatcgtgctagggaatgtatttgtggcatttgctgtgtcctacttcaaagcgcttcacacgcccaccaacttcctgctgctctccctggccctggctgacatgtttctgggtctgctggtgctgcccctcagcaccattcgctcagtggagagctgctggttcttcggggacttcctctgccgcctgcacacctacctggacaccctcttctgcctcacctccatcttccatctctgtttcatttccattgaccgccactgtgccatctgtgaccccctgctctatccctccaagttcacagtgagggtggctctcaggtacatcctggcaggatggggggtgcccgcagcatacacttcgttattcctctacacagatgtggtagagacaaggctcagccagtggctggaagagatgccttgtgtgggcagttgccagctgctgctcaataaattttggggctggttaaacttccctttgttctttgtcccctgcctcattatgatcagcttgtatgtgaagatctttgtggttgctaccagacaggctcagcagattaccacattgagcaaaagcctggctggggctgccaagcatgagagaaaagctgccaagaccctgggcattgctgtgggcatatacctcttgtgctggctgcccttcaccatagacacgatggtcgacagcctccttcactttatcacacccccactggtctttgacatctttatctggtttgcttacttcaactcagcctgcaaccccatcatctatgtcttttcctaccagtggtttcggaaggcactgaaactcacactgagccagaaggtcttctcaccgcagacacgcactgttgatttgtaccaagaatgattccttctactaaatgcaggcaaggagtaggacctcacaggaaagataagtggcactgtgaccgtgggctgtgtggtgttg

SEQ ID NO: 6933 - DNA, 1029 bp, Homo sapiens
atgaccagcaatttttcccaacctgttgtgcagctttgctatgaggatgtgaatggatcttgtattgaaactccctattctcctgggtcccgggtaattctgtacacggcgtttagctttgggtctttgctggctgtatttggaaatctcttagtaatgacttctgttcttcattttaagcagctgcactctccaaccaattttctcattgcctctctggcctgtgctgacttcttggtaggtgtgactgtgatgcttttcagcatggtcaggacggtggagagctgctggtattttggagccaaattttgtactcttcacagttgctgtgatgtggcattttgttactcttctgtcctccacttgtgcttcatctgcatcgacaggtacattgtggttactgatcccctggtctatgctaccaagttcaccgtgtctgtgtcgggaatttgcatcagcgtgtcctggattctgcctctcacgtacagcggtgctgtgttctacacaggtgtcaatgatgatgggctggaggaattagtaagtgctctcaactgcgtaggtggctgtcaaattattgtaagtcaaggctgggtgttgatagattttctgttattcttcatacctacccttgttatgataattctttacagtaagatttttcttatagctaaacaacaagctataaaaattgaaactactagtagcaaagtagaatcatcctcagagagttataaaatcagagtggccaagagagagaggaaagcagctaaaaccctgggggtcacggtactagcatttgttatttcatggttaccgtatacagttgatatattaattgatgcctttatgggcttcctgacccctgcctatatctatgaaatttgctgttggagtgcttattataactcagccatgaatcctttgatttatgctctattttatccttggtttaggaaagccataaaacttattttaagtggagatgttttaaaggctagttcatcaaccattagtttatttttagaataa

SEQ ID NO: 6934 - DNA, 6976 bp, Homo sapiens
ccggaagtggctgaggccggcagcagcgggcggcagctgcggcgcaaccggctccggagctgcctggcgcggccgggcgggcggcgccgctcaggctcgggctccggctgggcccggcgcggcctcggggctgcccatggggcgcggggggccgggccggtgacgccggacgcccatggacgcctctgaggagccgctgccgccggtgatctacaccatggagaacaagcccatcgtcacctgtgctggagatcagaatttatttacctctgtttatccaacgctctctcagcagcttccaagagaaccaatggaatggagaaggtcctatggccgggctccgaagatgattcacctagagtctaactttgttcaattcaaagaggagctgctgcccaaagaaggaaacaaagctctgctcacgtttcccttcctccatatttactggacagagtgctgtgataccgaagtgtataaagctacagtaaaagatgacctcaccaagtggcagaatgttctgaaggctcatagctctgtggactggttaatagtgatagttgaaaatgatgccaagaaaaaaaacaaaaccaacatccttccccgaacctctattgtggacaaaataagaaatgatttttgtaataaacagagtgacaggtgtgttgtgctctccgaccccttgaaggactcttctcgaactcaggaatcctggaatgccttcctgaccaaactcaggacattgcttcttatgtcttttaccaaaaacctaggcaagtttgaggatgacatgagaaccttgagggagaagaggactgagccaggctggagcttttgtgaatatttcatggttcaggaggagcttgcctttgttttcgagatgctgcagcagttcgaggacgccctggtgcagtacgacgaactggacgccctcttctctcagtatgtggtcaacttcggggccggggatggtgccaactggctgacttttttctgccagccagtgaagagctggaacggattgatcctccgaaaacccatagatatggagaagcgggaatcgatccagaggcgagaagccaccctgttagatctgcgcagttacctgttctctcgccagtgcaccttgctgctcttcctgcagaggccgtgggaggtggcccagcgcgccctagagctgctgcacaactgcgtgcaggaactgaagctcttagaagtctctgtcccacctggtgctctggactgctgggtgtttctgagctgtctggaggtgttgcagaggatagaaggctgctgtgaccgggcacagatcgactcaaacattgcccacactgtggggctatggagctatgccacagaaaagttaaagtccttgggctatctatgtggacttgtgtcagagaaaggacctaactcagaagatctcaacaggacagttgaccttttggcaggtttgggagctgagcgaccagaaacagccaacacagctcagagtccttataagaaactgaaagaagcattatcgtcagtggaagcttttgaaaaacactacttagatttgtcccatgccaccattgaaatgtatacaagcattgggaggattcgatctgctaagtttgttggaaaagatctggcagagttttacatgaggaaaaaggctccacaaaaggcagaaatctatcttcaaggagcactgaaaaactacctggctgagggctgggcactccccatcacacacacaaggaagcagctggccgaatgtcaaaagcaccttggacaaattgaaaactacctgcagaccagcagcctcttagccagtgaccaccacctcactgaagaggagcgcaagcacttctgccaggagatacttgactttgccagccagccgtcagacagcccaggtcataagatagtgctacccatgcattcctttgcacaactgcgagatctccattttgatccctccaatgccgtggtccacgtgggcggcgttttgtgcgttgagataaccatgtacagccagatgcctgtgcctgttcacgtggagcagattgtggtcaatgtccacttcagcattgagaaaaacagctaccggaagactgcggagtggcttaccaagcacaagacgtccaatgggatcattaactttccacccgagaccgcacctttccctgtatcccaaaacagtttgcccgcgctggagttgtatgaaatgtttgagagaagcccatctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctcacatctaccccattgtgcagtacgacgtgtactcacaggagccccagctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagaacagtcttctgaggccgcgctccggattcagtcctccgacaaggtcacgagcatcagtctgcctgttgcgcctgcgtaccacgtgatcgaatttgaactggaagttctctctttaccttcagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctcagcggtgaggtggtttagggataaatgtttctggaaccctgtggtcccccataatgttgatagaatatcatatgcactgggagttaaatatatttaatttaatgatcattatatatgtgggggttaatatgttgtttttctgtccctttaaagtctttacatgtaattgtagctgtataatcgttatttttcttttgcatcttaagtcttagaaattaagatattccatcgtgaggatgagagaggtcctcagtgtgtttttggtctggttgtagggaaggactcaagtcctggaatgtcctccactggtctactgagttgcagtcacactgttccaatggattatttgctttcggttgtaaatttaattgtacatatggttgatttattatttttaaaaatacagactaactgatgtaatgtttatgtataagttgcaccaaaaatcaaggacaaaaataagtgtgtttgtttttacaggtgtgaaagtcacagcttgtaaataagtgttgtatgtattaaaccttttccagttctccaaagcgatgtatttttgtacacttgaaatagagtactcttaatttactgggcaaatgtgcttggaattgaacttgacaagattagctcaagcagatagagtcgggtccagcagtgggtggccctcgtgtgaatccccgtggatgtgcaagttgtggagagaaggagcaccgggttcctgcccagcactgtgcttgcgggaggcggtggggcatgggaggaaggaggcacagaccggggaaatatgacagccgtcatttccagtattctctgtgttgtcttttagctcattcaataaataaaggtggtgtgatttttttttcctcctgtctttttcatttgtagaaactggagacgtgtaaagaagataaataattgtgtaattaaactttccagaaatttatcttcctcatgtgcagtttaacaaacttggtcaaactagttagcaaattagaacttcagaatctaatgatagtttagggtttctaaaataaggttttttattgtaaaaattgacgattgccctgcatttctaccaagtcctgtgaataaagagatgggagatttgattccgtcagaagagactgtaatccgtgtcgtcagcctgggagccttccccagtgtaatgtagctttctctcttaccttctggaagagggaatgtttcatttattactgtttgattttcttgtatctggttctactcccaggatgaaattatccaactacatatatatttagaggaagaaagtgaaggggaaatttaaaatgtttacggcgcttaattgcctggaaatgaaatgaaatcaaatttatcagtttttttccccctaattacccaaaagatcttttgcaaactatgttacatgaatgcttctgcctctttaagacaaagaagaatgtcacccaaaattgtcatttttttcttaatgttcatcataaaagtcctaaaagagtaactgtaattggatgtttattgtttttatctaaagtaaggtgtatgtgtttgagacaagctggttttgttgataaagagatgttaaataattgtgaagccagatatgcaatgtgtatctgaaaagcaaggaatttgcagccgttttacaaatatctgtggaacatgtaaatactgtcaaatggaaaataaaataagttataatttttgtgaatttcatgggatgtcctatgattggaaaaattataactcttctgattctaatgtggaaattgttgtatttaatctgaaaatgactttacctacaacagttccattgtcagcacagcctaggaaggtcagatcctgtattaattactcttagtggagatgccagatatcccatacagaattagcagagaaaatacacacaggcttctattcaaattttctttagtgcttaaaattaagttttaaaatgaaatcagacactgcaggtttgtatataaaatgaaaagctatactactttttacaaaagggcaaactgggctgatgtaaatgttttactttcaactgtgttctttaaaataaatcctacctggtttttaaattttatttttcatgaaaatgctcctttctctacatttattcatcctatatacatcaggctgtaagaccccccccagtcatcattaatacaatgtgttgggattctgtgactggaaaaggtgacaagttggtgactttgacactgcaggtattccattttcatggtttactatgaaaagtcatttttcatattatgtaatatattgttagattaaaaccattgtattaagactttaaaatgtaagcattgtaattctgaaaatacacattttaagaagaaa

SEQ ID NO: 6935 - DNA, 2215 bp, Homo sapiens
ctgataactccttgaacacgactgggattatctgcagaaacgtccacatgctcctgagaaggcaggagagcagctcctctctagagatgccctcaggggtggctctggaggagggtgcccacgtgctgaggtgcagccacgtgaccctggaaccaggggccaaccagataacattcaggactcaggccaaggaacctggaacgtatacactcaggcagctgtgcgcctcggtgggctccgtgtggttcgtcctccctgcacgtggagccgctggctgatagccttctggcaggcattcctcagagagtcaagttcactgtcactaccggccattatacgataaagaatggagacagcctgcagcttagcaatgccgaagccatgctcatcctgtgccaggcggagagcagggctgtggtctactccaacacgagagccccagcactcggaggggagagtgacatgctggggatggcagagccccacaggaagcataaggacaaacagagaactggccgctgcatggttaccacagaccacaaagtgtcgattgactgcccgtggtccatctactccacagtcatcgcactgaccttcagcgtacccttcaggaccacacacagcctcctgtcctcaggaacacggaaatatgttcaagtttgtgtccagaatttgtcagaacttgactttcagctgtcagatagttatcttgtagataccggtgatagtaccgacctgcaactagtaccactgaacacgcagtcccagcagcccatctacagcaagcagtcggtgttcttcgtctgggaactcaagtggacagaagagcctcccccttctctgcattgccggttctctgttggattttccccagcttctgaggaacagctgtctatctccttaaagccgtatacttatgaatttaaagtggaaaatttttttacattatacaacgtgaaggctgagatctttcccccttcgggaatggagtattgcagaacaggctccctctgctccctggaggttttgatcacgaggctctcagacctcttggaggtggataaagatgaagcactgactgaatctgatgagcatttttcgacaaagcttatgtatgaagttgtcgacaacagtagcaactgggcagtgtgtgggaaaagctgcggtgtcatctccatgccagtggctgctcgggccactcacagggtccacatggaagtgatgccgctcttcgccgggtatctccccctgcccgacgtcaggctgttcaagtacctcccccatcattctgcacactcctcccaactggacgctgacagctggatagaaaacgacagcctgtcagtagacaagcacggggacgaccagccggacagcagcagcctcaagagcaggggcagcgtgcattcggcctgcagcagcgagcacaaaggcctacccatgccccggctgcaggcactgccggccggccaggtcttcaactccagctcgggcacacaagtcctggtcatccccagccaagatgaccacgtcctggaagtcagtgtaacatgacaacgccagggtgaacacacgccacttcccagctaggagtgcactttatgggactgtgactggactcttccgttctggctccagccagaccttcagtggtcctgcctggccgtggggacatcagagagtgtcatcacgcagctggccagctgagttctgttgttgttttcatgccgcctgtgatctcagattcctgcttttctcaccccgtccccatgctggtgtccgacgccgcttactcagagccctggcctccctccccctacctcacacgctgctcatgaaagtttccacccacgctgtctccacggaacagcctccgtctgctggctcttcgtggaaggccatttgtctttcaggtagacactcagcagccctcacggtcttagtgacgtgtgtgcctttctggtcacacagctgcccagtttcctgatcggggtggatttgtgtcccctaaggggtaaaacagccgtttaccgcagatcctctcattgtgcttttctagaataacacccttctaggggaggcgggtgggggagggagggatcataaccccttctgtgccttgggatgccggagctgggggacctggaggcccatcagccggagccacgtgaaaggtactgaagaaagctgagacccggctgtgaggagcgcctca

SEQ ID NO: 6936 - DNA, 732 bp, Homo sapiens
gtgacggagcggaaaagcgcgagaagcggcttggttccttgtacgcagaggcggtagtgacacaggcacaactgacagtggcagaagctcagctgacaaggactggggacggcggtgtccttgtcttgcctttgtcgcccccgcccctctcttccctggctggacttgcggagtccccgccgaagaacccgaggagccatatattgaagaccatgtctggaagcttctactttgtaattgttggtcaccatgataatccagtttttgaaatggagtttttgccagctgggaaggcagaatccaaagacgaccatcgtcatctgaaccagttcatagctcatgctgctctcgacctcgtagatgagaacatgtggctgtcgaacaacatgtacttgaaaactgtggacaagttcaacgagtggtttgtgtcagcatttgtcaccgcggggcatatgaggtttattatgcttcatgacataagacaagaagatggaataaagaacttctttactgatgtttatgatttatatataaaattttcaatgaatccattttatgaacccaattctcctattcgatcaagtgcatttgacagaaaagttcagtttcttgggaagaaacaccttttaagctgaatggagaaaattccaaaataaattatatcaccacaatggtgtatactcaggaatgtgtacattgtaaattacttgattaaatagcctggaaatcttt

SEQ ID NO: 6937 - DNA, 796 bp, Homo sapiens
cctggtgagaccctacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggagggtgggtttctccccagtgtagagggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctccccacgtg

SEQ ID NO: 6938 - DNA, 770 bp, Homo sapiens
ggtgagaccctacccacccccctgcccgcgccgggcctcgtccgctccccggccccttccccgcgggcgtgtgggtcccgggctggggtctcggcgtccgcgatcccgagcccgctcgcttcggcccccctcaggaggctgcgaggaggggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctccccacgtg

SEQ ID NO: 6939 - DNA, 649 bp, Homo sapiens
aaagcagctcggccgagcagactgctgcggttcctgggtggcggcggcatggaggcgcgcttcacgcgcgggaagtcggcgctgctggagcgcgcgctggcgcggccgcgcaccgaggtgagcctgagcgccttcgcactgctgttctccgagctggtacagcactgccagagccgcgtcttctccgtggccgagctgcagtcgcgcctggccgcgctgggccgccaggtgggcgcgcgcgtgctggatgcgctggtggcgcgcgaaaagggtgcccggcgtgagaccaaggtgctaggcgcgttgctcttcgtcaagggcgccgtgtggaaggcgctcttcggcaaggaggcggacaagctggagcaggccaacgatgacgcgcgcaccttctacatcatcgagcgcgagccgctcatcaacacctacatctccgtgcccaaggagaacagcacgctcaactgcgccagcttcacggcgggcatcgtggaggcggtgctcacacacagcggcttccctgccaaggtcacggcgcactggcacaagggcaccacgctcatgatcaagttcgaggaggcagtcatcgctcgagaccgggccctggagggccgctgaccctgccggagataaaggatacagagagcccctc

SEQ ID NO: 6940 - DNA, 794 bp, Homo sapiens
ggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaatctg

SEQ ID NO: 6941 - DNA, 758 bp, Homo sapiens
aggcgtgcgaggagggggcatggcggatactgtgttgtttgagtttcttcacacggagatggtggctgagctgtgggctcacgaccccgaccccggcccggggggacagaagatgagcctgtcggtcctggagggtatggggttccgtgtgggccaggctctaggcgagaggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaa

SEQ ID NO: 6942 - DNA, 695 bp, Homo sapiens
aggcgtgcgaggagggggcatggcggatactgtgttgtttgagtttcttcacacggagatggtggctgagctgtgggctcacgaccccgaccccggcccgggggctgccccgggagacgctggccttcagggaggagctggatgtcctcaagttcttgtgcaaagacctgtgggtggcggtgttccagaagcagatggacagcctgcgcaccaatcaccaggggacctacgtcctgcaagacaacagcttccccctcctcctcccgatggcctctggcctgcagtatctggaggaagcacccaagttcctggccttcacctgcggcctcctgcgcggcgccctctataccctgggcattgagagcgtggtcaccgcctccgtggcagccctgcccgtctgtaagttccaggtggtgattccgaaatcctaagcctgcctcgcacctgctgagccgcactgctgcccctggcctcaccggcctcaggagacggtggggccgctgcatttcggggtggtcttgggaatcccaggccctaggggtcacatttgctcaggaagtgggtatcaaattgaggtgggggtgtcagaggaggcaaaggggtcccagctgcggtcaggactgtggtgggattcccgcctcggcagcgtcactgcccagtagctgctcaataaaggctgtgtgtgtggaatctga

SEQ ID NO: 6943 - DNA, 3242 bp, Homo sapiens
cggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagggcatctatgtacttcaggacaacaaatttcgcctgcttactcagatgtctgcaggaaaacagtatttagaacatgcatctaagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgata

SEQ ID NO: 6944 - DNA, 3229 bp, Homo sapiens
cgcccccgcccagcggccggatcgcatctcagctggttggctttggttagagctcccgtcagactttagttcggccctaggatttggtagccccgaagtgtgggctctctccagtaccagactcatttcagtaccagcctttgggaagtcgtgtgaatacctcggtctcttagccacagggatagaatggcggcctgacggagccgcggcgccggcgaagtcgctgaggcgcgagctggaacccccagaccagctcaaacgggagccaaaactcgaagcttggaagaattagcaggaaatggcggatgaggcgttgtttttgcttctccataacgagatggtgtctggagtgtacaagtccgcggagcagggggaggtggaaaacggacgatgtattactaagctggaaaacatggggtttcgagtgggacaaggattgatagaaaggtttacaaaagatactgcaaggttcaaggatgagttagatatcatgaagttcatttgtaaagatttttggactacggtattcaagaaacaaatcgacaatctaaggacaaatcatcagtatttagcatttacgtgtggcttaatcagaggtggcttatcaaacttgggaataaaaagtattgtaacagctgaagtgtcttcaatgcctgcttgcaaatttcaggtgatgatacagaagctgtagaacatactgaaatgcaaggcttcaacagtgtaaagagataaattattcatgtaaaagtatttcaagtagtgatgatttaattacattgttcgatgtttgtacaggagtaagcatgtatttttatcaatttaacacagatcaaaggagatgaagggacattctgccatgacatacacttaaccaaaactattcaaaatgaaaaccggatttcaaataaccagacaccaagatgcagggcccttattttaaacctttttatttggttagagtgatatgtatttagccatagatggagaaacaaagctcagggtttgttgaattagcatgagagaaaattatgtaccaacagaattatttgtgagaagaatgaacaaattttgataaagtatgaatttgttttattttaaaaagcaaacatactaaattttttttattttattgcttataatttattaagaatgtttacacctgtataaggatttcatatatacattgtatgtgtgtatatataaatacatatatgactgcctaaattgtttataaatttaatttttctttaataggtttcattccttcagagctccattaatgtaatcaaaatgaaatatagattagtttaaatgtgaattcagtgactctagggccaaagaatattaggtatgtttggaaagaatttttgtatttattcctgttacagttttgactttcaacttctctccccgtgcatggaagtcctggtaaaggatctaacatctttattcccttctttcctcttccagctgagcagagttggataattgaattagtcattctgacattctttggaccatatcatcttagtggtttggggtcagtgctcatctgatatatctttcttaccacctcttctacttactttctcttacttaaattatctggcataagcagttatctccagcttttgttagaatcttgcatgttgattactaaaactatactttgtttcccatttatttattacccttttgcatgtatttgtgtgacagggaactctgcagcagggggtgactgacacaccaaacaagatgtttcactgggtactctgccatagaaatggcagattaagaagattgactataccaaacattatattaaaaacacaaaataaaaactataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgggagtaggtggggagaaacttaaaggttcacttgtaaaacaataaagtactaaagaaaatgtgata

SEQ ID NO: 6945 - DNA, 3573 bp, Homo sapiens
gcataccatttgacctttcaaaggttctccagcagtatttaactgatgcaaaaggaacacacttgcaattttctacttttgacatgacagaccctcctcttagttcacacaatgttcaaaaggcacaagtccctcgcttcggaacgcaagagagcattactttcccaaagagctacacggttcatactgaaggatgatatgagaaattttcactttttgtcaaaacttgtactctcagcgggccctctaagaccaactccagcagtcaaacattcaaaaacgactcactttgagattgaaatatttgatgctcaaacaaggaaacagatatgtattctggataaggtgacacaatcatctactattcatgatgttaagcaaaagtttcacaaagcatgtccaaagtggtacccttctcgagttggtctgcagctagaatgtggcgggccttttttgaaggactacattaccattcaaagtattgcagcttcctccattgtcacactgtatgctacagacctaggtcaacaagtcagttggaccacagtgtttttggctgaatacacaggacctctgctaatatacctcctcttttatttgaggatcccatgtatatatgatggaaaagagagtgctagaagattacgccacccagtggtacacttggcttgcttctgtcattgtatacactacatccgataccttttggaaaccttatttgttcacaaagtttctgcaggacacacacctttgaaaaatttgataatgagttgtgccttttactggggatttacttcttggattgcctactacattaatcatccactatatacaccaccatcatttggaaacaggcaaatcacagtatctgctatcaattttctgatttgtgaagctgggaatcatttcatcaatgtaatgttgtctcatcccaatcacacaggaaacaatgcctgtttcccaagtccaaattataaccccttcacatggatgtttttcctggtttcatgtcctaactacacctatgagattggatcatggattagtttcacagtcatgacacaaacactgccagttggaatttttacacttctgatgagtatccagatgtctttgtgggcacaaaagaaacataagatttatctgagaaaattcaattcatatattcatagaaaatcagcaatgattccattcatattgtaaaaaaagaatcttatctcctatagaaaacagcaacatataaattcaataaataagacttagttaaggatagttaactattatactccaacaattcatgagcaacagtatatacactgagtaaaaatataaaatagtaaaatttcactaaatttagagaaatgcacatggtaataaaaagtataaattataaatgcaattaactaagaacagctctgaatgtatttgcatgggattggtccttgaataaaattgtcttacttcattaatacttcacaatactatttgcataagacaaaataccacagcaaaaaaaaaaatctgattaacaaatgaaaaagcgatctgaacagacatttcccaaaggaagacatatacatggtcaataagtatatttttaaaatgctcaacattaactattcatacagaaatgcaaatcaaaaccacaatgagatatcatctcatcctaattaaggtgactattttcaaaaagacaaaaaatatgacagccgtggtggttcatatctgtaatcctaacactttgacaggccaaggcaggggaattgcttgagttcagaagtttgagatctgggcaacatattgagactctgtctctaaaaagcatattgagactctgtctctacaaaaaaattttaaaaagtaaaaattagctgggcgtggtggcacatgccagtaggtagtcccagctactcgaggttgctccagctcaggcgttcaaggctacagagagccatgattaaaccaaggcactccagcctgggtgacagagtgagactgtctcaaaataaaataaaaataacatattggtgaagatgcgggaaaaaaaaaagaactcttagacactgctggtgggaatgtaaactagagcagccatgtggagaacaacatggactttcttcaaaaattacaaatagaactatcatatgatccagcaataccattactggaaaaaggaaatctgtatattaaagagacatttgaaccctatgtttactgcagcactattcacaatagccaagatataggagcaacctaggtgtccaacaacagatgaatggataaagaaaatgtggtatatatacacaatagaatactatgcagccataaaaactgaattcctgtcattcaggacaacatggatggaattggagggcatatgttaagtgaaacaagccaggaacagaaagttaaacattgcatgttattacttatatgtggaagctaaaaaaattgatatcatagaagtaaaaaataaaacagaggatactacaggctgggaaagctgcagcaaagggagactagagagagatttgttaaaggatacaaagttacagcttggtaggaggaataatttctggtgttctataccactgtaggacgactatagttaagaacattatattccatttagtttcaaatagctaaaaggagattttgtccccaacaaaaagaaatgataaatatttgaaaccatggatactctaatttctctgatctgaccactataaattatatgtattgaaacattattatgtatctcccaaatatgttcaattcttatgtcgctcaaaaaataaaatttaatttaaaaagtatctgatttttaaagtaaatattttttaaagttttgacatttaaattacttgaatctcattattttgacaataatttaattcttttattgttcaatctgttagtgagatgtgtcataggtattatgtcattagttcaaattcttgcggaaattatagctatattaaaagtgtaacatttttatttagttgtgtacttatttgttaataatacagacattgtatgttatcatactgaaatttacaattaaaatattttctgtagattatttgaaaatcattctaaatatatattttgaaatatatagattatatttgtatgtaaattatatttatacatcttctgaaatatatttcaaaatatgtgtgtacgtgtgtatatgtgtatatatatacacatatatatacacatacacaaatatatgcatatttcaaatggattgtatgcacttgcaaagcaaaagtacattggtaatttgggcacattcagagtggaaaaaatttgttctatttttacatctttaaatacctatcttctatgaaagcctatgtgcatgtgtgtgtgtgtatgagtttctatgtgagcatgcatatatacttcacaaagagatgacctatataaatcaaagtacacattatttaaaatatttaaaaaaattttcagtttcttcatttttaaattgtgatttttagatttgttagtctatggagtattttcaattctcagattatacatatgttataaaatatgttcattaaa

SEQ ID NO: 6946 - DNA, 3046 bp, Homo sapiens
gggtcagggctagagccgtgagtgtcagcctgggatgggctacataaggcccagctctggcaccagagcttcattctttgttgcacagcaaactgcagaggtcactccaggctgtggctccacatcccgaggaacaaaagcgggcctgctcagctgtctgcaaggacggccgttccagaccaagtggcctgctgctccgaggacccagctcgctccaggctgtgactccacatcccgaggtcgctgcctggcgaccgggcagcgaggaccggccaccccagacttcctgtcccgcagccccaaagacagagctgcgaccgccgggacagcgacgcctgcacagctctggtgagatggcggcagggtccactacgctgcacgcagtggagaagctgcaggtgcgtctggccactaagacggagccgaaaaagctagagaaatatttgcagaaactctccgccttgcccatgacggcagacatcctggcggagactggaatcagaaagacggtgaagcgcctgcggaagcaccagcacgtgggcgactttgccagagacttagcggcccggtggaagaagctggtgctcgtggaccgaaacacccggcctggcccacaggaccctgaggagagcgcttcccgacagcgcttcggggaggctcttcaggaccaggaaaaggcctggggcttcccagaaaacgcgacggcccccaggagcccatctcacagccctgagcacagacggacagcacgcagaacacctccggggcaacagagacctcacccgaggtctcacagtcgcgagcccagagctgagagaaagtgccccagaatagccccagctgattccggccgctatcgggcctctccaacgcgcacagctcccctccggatgcccgagggccctgagcccgctgcgcccgggaagcaacccggaagaggccacactcacgcggctcagggcgggcctctgctgtgtccaggctgccagggccaaccccaggggaaagccgttgtgagccacagcaaggggcacaaatcgtctcgccaggaaaaacgccccttgtgtgcccagggagattggcactcccctactttgatcagggagaaatcatgcggggcctgcttaagagaggaaaccccaaggatgccctcctgggcaagtgccagggacaggcagccttcggacttcaagacagacaaggaaggggggcaagctggcagcggccagcgtgtccctgccttggaggaggctccagacagtcaccagaagaggcctcagcacagtcactcgaacaagaagaggcccagtctagacggccgggacccaggaaatgggacacacggcctgtcgcccgaggagaaagagcagctttccaacgaccgagagactcaagaggggaagccaccgactgctcatttggacagaacgtccgtgagctccctctctgaggtggaggaggtagatatggctgaggaattcgagcagcccactctgtcatgtgaaaaatacctcacctacgatcagttgcggaagcaaaagaaaaagactggaaaatctgccaccactgcacttggagataaacaaaggaaagcaaacgaatccaagggcactcgtgagtcctgggattcggctaagaaattgcctcctgtccaggaaagccagtcagagaggctgcaggcggccggcgctgattccgccgggccgaaaacggtgcccagccatgtcttctcagagctctgggacctctcagaggcctggatgcaggccaactacgatccgctttcggattctgactccatgacctcccaggcaaagccagaagcactctcttcaccaaagttccgggaggaagctgctttccctggacgcagagtgaatgctaagatgccggtgtactcgggctccaggcctgcctgccagctccaggtgccgacgctgcgccagcagtgtgcccaggtgcttagaaacaatccggacgccctcagcgacgtgggagaggtcccctactgggttcttgaacctgttctggaagggtggaggcccgatcagctgtatcgcagaaagaaagacaatcacgcactcgttagagagacagacgaattacggaggaatcattgtttccaggacttcaaggaagaaaagccacaggaaaacaaaacttggagggagcagtacctgcggcttccggacgccccagagcagcggctgagagtaatgacaacgaatatccgatctgcacgtggaaacaaccccaacggcagagaggcaaagatgatctgtttcaaatctgtggccaagacgccttatgatacttcaaggaggcaagagaagtctgcaggagacgctgaccccgaaaatggggagatcaagccagcctccaagcccgcgggaagcagccacactccctccagccagagcagcagcggcggtggcagagacagcagcagcagcatccttcgctggctccctgagaagcgggccaacccctgcctgagcagcagcaatgagcacgcggcgcccgcggccaaaacccggaaacaggctgccaagaaagtggccccgctgatggccaaggcaattcgagactacaagagaagattctcccgacgataaactcaggacttgccttgcagataaaatctggggggatttttgcattggcaaagtcaatgcgggttggggaacgaaacttccaatggacaccagaacctttaacttggtgcaaagttgagcctttgaattctgcaggtgtcatgtgctggccctgtgattttgcctcccacacccagccactacctcccagcttggagaacacctcagaattcagaagatatgaacgcattgggaacaattctattttggatgttcactgataatttttaaaaacaccctagttgtaatcataaataaggaaaaagatgtgagatttcctttttcctttcttttttttttcgaaatcaagtagataagaacttcttagacaaaaacacacaagccattagttgacactgataactccgaatacataaaatgtttgctgttgc

SEQ ID NO: 6947 - DNA, 1877 bp, Homo sapiens
acatcccgaggaacagaagcgggcctgctcagctgtctgcaaggaccggcgttccagaccaagtggcccgctgctccgaggacccagctcgctccaggctgtgactccacatcccgaggtcgccgcctggcgaccgggcagcgaggaccggccaccccagactgcctgtgccgccgccccgagctcggacagagccgcgaccgcgaggacagcgacgcctgcacagctctggcgagatggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccggcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccagcgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggttcttgaacccgttctggaagggtggacgcccgatcagctgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 6948 - DNA, 1877 bp, Homo sapiens
acatcccgaggaacagaagcgggcctgctcagctgtctgcaaggaccggcgttccagaccaagtggcccgctgctccgaggacccagctcgctccaggctgtgactccacatcccgaggtcgccgcctggcgaccgggcagcgaggaccggccaccccagactgcctgtgccgccgccccgagctcggacagagccgcgaccgcgaggacagcgacgcctgcacagctctggcgagatggcggcagggtccactacgctgcgcgcagtggggaagctgcaggtgcgtctggccactaagacggagccgaaaaagctagagaaatatttgcagaaactctccgccttgcccatgaccgcagacatcctggcggagactggaatcagaaagacggtgaagcgcctgcggaagcaccagcacgtgggcgactttgccagagacttagcggcccggtggaagaagctggtgctcgtggaccgaaacaccgggcctgacccgcaggaccctgaggagagcgcttcccgacagcgcttcggggaggctcttcaggagcgggaaaaggcctggggcttcccagaaaacgcgacggcccccaggagcccatctcacagccctgagcacagacggacagcacgcagaacacctccggggcaacagagacctcacccgaggtctcccagtcgcgagcccagagccgagagaaagcgccccagaatggccccagctgattccggcccccatcgggaccctccaacgcgcaccgctcccctcccgatgcccgagggccctgagcccgctgtgcccggggagcaacccggaagaggccacgctcacgccgctcagggcgggcctctgctgggtcaaggctgccagggccaaccccagggggaagcggtggggagccacagcaaggggcacaaatcgtcccgcggggcttcggctcagaaatcgcctcctgtccaggaaagccagtcagagaggctgcaggcggccggcgctgattccgccgggccgaaaacggtgcccagccatgtcttctcggagctctgggacccctcagaggcctggatgcaggccaactacgatctgctgtccgcttttgaggccatgacctcccaggcaaacccagaagcactctccgcgccaacgctccaggaggaagctgctttccctggacgcagagtgaacgctaagatgccggtgtactcgggctccaggcctgcctgccagctccaggtgccgacgctgcgccagcagtgcctccgggtgcctaggaacaatccggacgccctcggcgacgtggaaggggtcccctactcggttcttgaacccgttctggaagggtggacgcccgatcagccgtaccgcacagagaaagacaatgccgcactcgctcgagagacagatgaattatggaggattcattgcctccaggacttcaaggaagaaaagccacaggagcacgagtcttggcgggagctgtacctgcggcttcgggacgcccgagagcagcggctgcgagtagtgaccacgaaaatccgatccgcacgtgaaaacaaacccagcggccgacagacaaagatgatctgtttcaactctgtggccaagacgccttatgatgcttccaggaggcaagagaagtctgcaggagccgctgaccccggaaatggagagatggagccagcccccaagcccgcaggaagcagccaggctccctccggcctcggggacggcgacggcggcagcgtgagcggcggcggcagcagcaaccggcacgcggcgcccgcggacaaaacccgaaaacaggctgccaagaaagtggccccgctgatggccaaggcaattcgagactacaagggaagattctcccgacgataa

SEQ ID NO: 6949 - DNA, 1891 bp, Homo sapiens
cttctaagaggaataccgctccagcgccaacgcaatctcctcctccctcgcctttacctaatcccttgcctgccctgtttccccgctgagctcctcaaacacttcgcatctctccccgttattccagtctacctggtgaaaaggttatttgaggaccttgtctacgctgcccctacctgatcccgctcccggcgccacaggctgggccccaacaggagctcctcaatctaagtgtctaggagaaacccagggagtctccacgaaggaggcactttacccactacagactaaaactggcctcggaatcgccttcctggagattcggcccagcggctctcaggagtcggtaggggcaagaacgtttccccggtgcagtggaagaagactgcgggccagccagggactcgggatccggggacagggcctcggcaggcgcccgcctggaagcccgcagcccagacgcggacgacccactgctcagcgggacacacctcgggccttgccccggaacgccgcttggacaacaacctttccgccgagtgcaggccgagcgcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattc

SEQ ID NO: 6950 - DNA, 1339 bp, Homo sapiens
gcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggcagttaatagtatcatatctatcgtttttggtactcgaagaattgcctgggctcaccttgatcgtaagttgacagtgctggactggcagcaaagtgaccgttggagtttaatgagaggaatatactcatcatcagtctatttagaagagatttcctcgatcatttcaaagatgcctaaagcagatttctatgttctggaaaaaacaggactttccattcagaactcatctctgtttccaatactgttacattttcatatcatggaagccatgctgtatgccttattaaataaaacttttgcccaggatgggcagcatcaggtgctgagcatgaatcgaaatgcagtggggaagcattttgaactgatgattggtgactcccggactagtggaaaagagctagtgaagcagtttctcttcgattctatactgaaggcggatcctcgggtgttcttcccatcagataaaatagttcactacagacagatgtttttatctactgaactacaaagagtagaagagctttatgattcattattacaagctattgccttctatgaattagcagtgtttgactctcagccttagaattctgaggttaacgtgctaaagtataattattagctctaacgtaacaccaactgttgtgaacatccatgttattggaaaagaacacattttcagtgtattttagatgtttaaattctgacttttggctattaaatggtttacacaataagccaagaccaaatcaataaacattttatgagattc

SEQ ID NO: 6951 - DNA, 1142 bp, Homo sapiens
gcttttgggcgcagcacgcaggaaccggaagtcaatggaggaagactggacctactgattcaacttggagatgagcgggtctgtcctcttcacggcgggagagaggtggagatgctttctgaccccgtcgaggtcatccctgtactgggccttacataatttctgctgtcggaaaaaatccactacacctaagaaaattactcccaatgttactttttgtgatgaaaatgcaaaggagcccgaaaatgcacttgacaagctcttctcttcagaacagcaggcttccatcttgcatgtgttgaatacagcatctactaaagaacttgaagctttccgattgcttcgtggaagaaggtccatcaatatcgtagagcacagagaaaactttgggccatttcagaatttagagagtttaatgaatgtgcccttgtttaagtataaaagtacagttcaagtttgtaactccatactttgtccaaagactggacgggaaaaaagaaagtcaccggaaaaccggttcctgagaaagctcctcaaaccagacatagaaagagaaagacttaaggtatattcttcatgtctgctatactgcctaatatttgagaacctactctagaaagcactcaagtattaaactttagaggaactcatgtcctgtgtaacattgcttgataatcattatctcataaaaatcataagcaccattttttttctggaccagtgggtccgttttttgaggaatatgggtacttttgaaaacctgatgaaagctgtggaccctcttcccatagaaaaagatatagcacatatacacagaatactacacagtttcagaggactggcagattctgttaagtccactcatggactccaagtagaactgctgcaattgatctggaacatattttaaccaaattcttcagggaggattctcatccagattcatggccaaaactatttatacccagattagagtggagttgcatcttatttagggggctggattttaagtcagtttttatggagatataagtcatgcagtaaaatcctttaagaaaaaatcgattgccgacgaagtattgtgtgtagtctggttcagtaatgcttgtgcacagtaaagcttgagagtcacttagctaaag

SEQ ID NO: 6952 - DNA, 1848 bp, Homo sapiens
gaggcggaagcggaagtgagggagaaaagcaggaaggctccgctgttcgcatgcgcaggctctagtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagtccttaggaaaaaatctggatggaaaactacgagtgatccactgtgacttctttaaactagatcctagaagtggtggagtaataaaaccacctgctatgtcttctcgagggctctttaagaatttgggaatagaagcagttccttggacagcagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagggaattattagaccaattacaacaaaagctgtatcttattcaaatgattcctcgtcaaaatttatttaccaagaacttaacacctatgaactataatatattttttcacttgttaaagcactgttttgggaggcgcagcgccactgtaatagaccacttacgttcattgactccacttgatgcgagagatatattgatgcaaataggaaaacaggaggatgagaaagtagttaacatgcaccctcaagacttcaaaacactttttgaaactatagagcgttccaaagattgtgcttataaatggctgtatgatgaaaccctggaagataggtagcaactagactgtcgtttttggtggagcggttcatttatttggaaactatgacatgaaaaccaaatttgaaaactcacatcctttcagcagaaggtaactgttcttgtcttgcacaagccaggcagatcatttctcctaagctgatatcattggcttattggatgaaacagtgtctgctattttattcacaattgaataaaatgaaaacttcaattaattgtggatttgatcagattgaattcgttttgtttcagattcctatttaaatatttcacttgtactgttgctgatttttgcatcttcttgaagagcaagagtctgtacattattaagcttagaaagtaagcaaaactgatttactggtttgcctttcagtttgttgaaatgtattgtcaagtactgtacaatgaaattgtttaaattttaatatgatttaagctttttagaaattaaaatattttaaataagaag

SEQ ID NO: 6953 - DNA, 827 bp, Homo sapiens
agtgtttacttccgcttgacctggcccggacgccagaaaatgttccacgtgggataccctgcgtggggttcactgtagtagctgcactaggtgattcttggagcgggcctgagagacaaggacatgtggatcccagtggtcgggcttcctcggcggctgaggctctccgccttggcgggcgctggtcgcttttgcattttagggtctgaagcggcgacgcgaaagcatttgccggcgaggaaccactgtgggctctctgactcctctccgcagctgtggcccgaaccggatttcaggaatccgccaaggaaggcgtctaaggccagcttagactttaagcgttacgtaaccgatcggagattggctgagaccctggcgcaaatctatttgggaaaaccaagtagacctccacacctactgctggagtgcaatccaggtcctggaatcctgactcaggcattacttgaagctggtgccaaagtggttgcgctcgaaagtgacaaaacttttattccacatttggagacatccctttaaaagtagttggaatgttcccaagtagaggtgagaaaagggcactttggaaactcgcatatgacttgtattcctgtacttctatatataaatttggacgaatagaagtaaatatgtttattggtgaaaaagaattccagaaactaatggcagatcccggaaatccagacttgtatcatgtattaagtgttatctggcaattagcttgtgagattaaggttctgcacatggagccttggtcatcatttgatatatacacccggaaagggccgctggaaaacccaaagcgtagg

SEQ ID NO: 6954 - DNA, 2243 bp, Homo sapiens
agcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtca

SEQ ID NO: 6955 - DNA, 1917 bp, Homo sapiens
gggaagcgcgccgcgcacctcatggttccggggacagttagggcggcggatggaggtcagcggtggtgctcgctgcggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtca

SEQ ID NO: 6956 - DNA, 2225 bp, Homo sapiens
acgtcgcctatcccactccaccagcccagtcttccaccgccctaggaactctcctacgcctacgcaagcagggagggatagggtgacagcaccgacaacaaagggtcgtctcccgcactccgtatgaggatggcgtactggtcggggggcaaccgaagcctttcttcctaggttctttatcttttctaagtttcccatgacctatcgctccgcttgagccctcagcaaagatgtcacccgccgaaaggtgtggccggaagctggaggcgtggcttccggacgtgcggggcgaggctcgtctcgtttccgccggcgctccgagtgacgtagggaagcgcgccgcgcacctcatggttccggggacagttagggcggcggatggagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtca

SEQ ID NO: 6957 - DNA, 579 bp, Homo sapiens
cagtcttccaccgccctaggaactctcctacgcctacgcaagcagggagggatagggtgacagcaccgacaacaaagggtcgtctcccgcactccgtatgaggatggcgtactggtcggggggcaaccgaagcctttcttcctagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcat

SEQ ID NO: 6958 - DNA, 530 bp, Homo sapiens
tgctcgttccgtgctggcttgccagtgcgcacgcttcctctctagcccgcgcggccaggcctggaagacgccgcccctgttgaccgtccatgaccccagcgagccagttttcgtgacttagtgcaaggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaa

SEQ ID NO: 6959 - DNA, 2190 bp, Homo sapiens
gcgcacctcatggttccggggacagttagggcggcggatggaggtcagcggtggtgctcgctgcgacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtacttatccggctctctcacttgctgtctgagaagccagaagataaaggcttgctcatacaggatgcccactttcatcaacttctctgtctgctcaacagtcagattgcctcggtctggcatggtaccctctcgaagctgctgggaagcctgtatgctctgggcatccccaaggcctccaaggagctgcagtcggtggagcaggaggtccgctggcgcatgcggaagctcaagtacaagcacctggccttcctggcagagtcctgtgccaccctctcacaggagcagcactcgcaggagctgctggctgagctgctcacacacctggaaaggcgttggacagaaattgaagattcccacacattagtgaccgtcatgatgaaggtgggacacctctcggagccactaatgaaccgcctggaagacaagtgcctggagttggtggagcactttggccccaatgagctgcggaaggtgctggtgatgctggcagctcagagccggcggtccgtgcccttgctgcgggccatctcctaccacctggtgcagaagcccttctctctgacgaaagatgtgctcttggacgtggcctatgcctatggcaaactcagctttcaccagacccaggtgtcccagcgcctggccaccgacctgctatccctcatgcccagcctgacttctggtgaggtggcccactgtgccaagtccttcgccttactcaagtggctcagcctgcccctgtttgaggcctttgcccagcacgtcctgaacagagcgcaggacatcaccctgccccacctgtgcagcgtacttctggcttttgcgcgtctgaacttccatccagaccaagaggatcagttcttcagcctggtacatgagaagctggggtcagagctgccaggcctggagccagccctgcaggtggacctggtgtgggccctgtgtgtgctgcagcaggcacgggaagcagagctgcaagccgtcctccaccctgaatttcacatccaatttctagggggcaagtctcagaaggatcagaacaccttccagaagctgctccacatcaacgccactgccctgctggagtaccccgagtactcgggtccccttctgcctgcctcggctgtggcccctgggccctcagcccttgacaggaaggtgacccccctgcaaaaggagctgcaggagacgctgaaggggctgctggggagcgccgacaagggcagcctcgaggtggccacgcagtatggctgggtgctggatgctgaggtgctgctggacagtgacggcgagtttctgcccgtaagggactttgtggcacctcaccttgcccagccaactgggagccagtcaccacctccagggtctaagaggctagcgttcttgcggtgggagttccccaacttcaacagccgaagcaaggacttgctgggtcgctttgttctggcccggcgacacatagtggctgcaggcttcctgatagtggacgtcccattctatgagtggctggaactcaagtctgaatggcagaaaggcgcctacctcaaggacaagatgcgcaaagcggtggctgaggagctggccaagtgacttgtgccagcagcatggactgcgtgcctctccgccggaggtctagctgtgggcggccaagaagggtcacccttgaggacaaacctctgtgcaggaccttggccagagtggggagggtggccagccactctgagggacagaacgtcctcttgtgtataataaacctttaattttggtgttggacccctggggccttcccaggcttggtcaccctctgcactgtc

SEQ ID NO: 6960 - DNA, 548 bp, Homo sapiens
atggttccggggacagttagggcggcggatggaggtcagcggtggtgctcgctgctggagttagactaagctttttacagctgctttaatcccctcatataaaaagaaaatgtgctggccatataccaagttccaggaagtggagaaagatcaaacgtacattctgctttggcagaaatgaggcctagggtttggaatcacttgctaggagtcttgtctctctgccacccaggacatcatggcagctcacctggtaaagcgatgcacgtgcctcctgagagaagctgctcgtcaggcccctgccatggctccagttggccgactgagacttgcctgggtagcccataagactctgacttcctcagccacctcacccatttcccacctcccaggttccttgatggagccggtggagaaggaacgagcatctactccctacatagagaagcaggtggaccacctcatcaagaaggccacaaggccagaggagctcctggagctacttggtggcagtcacgacttggacagcaatcaagcagcaatggtac

SEQ ID NO: 6961 - DNA, 3675 bp, Homo sapiens
aattaacttctcttagtcttcaagcctagtacttgaatgtcaagtacctgcaagcctcaatgtccaagacttttaagagcggaaggtacgatgagttccatctttactagggtcacaaggaaggcatgggtatatggaaatttttattattattccatctgaatatcattttctagagaataggagcttttgttctgaagggctgccggcttccttctgggatctagcagccagggttagatcacaggtgtcactttcaggcgagtagttagcaacggtatcgctagcaactgagccgacccctgcagccagaggtttgcagtgggtagtgtgtattccagaaagggccctgacatgtgaaaggaaggaatgtgccctaatattctacagttgttttatcgttgctactgattaggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatata

SEQ ID NO: 6962 - DNA, 3548 bp, Homo sapiens
gggaagactgcactgccgcgaaggcggaggaggccggcagccggcacccccacactcggaccgcagccggcgcgatgtccaccaaggtcaggaagtgcaaagaacaagcaagggtgaccttcccggcgccggaggaggaggaagacgagggcgaggacgagggcgcggagccgcagcgccgccgccggggctggaggggcgtcaacggggggctggagccgcgctcggcgccctcgcagcgggagccgcacggctactgcccgccgcccttctcccacgggccggacctgtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagtttgtggctcatcccaactgccagcagcagctcttgacgatctggtatgagaacctctcaggcctaagggagcagaccatagctatcaagtgtctcgttgtgctggtcgtggccctgggccttccattcctggccattggctactggatcgcaccttgcagcaggctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatgatgcagcaacctggatttggctttgactatagcacaaatgtgggcaataatatttctaagtatgaaatacttgaaaaactatgatgtaaatttttagtattaactacctttatcatgtgaacctttaaaagttagctcttaatggttttattgttttatcacatgaaaatgcattttatttgtctgctttgacattacagtggcataccattgtgttgaaaagcccaatattactatattattgaaacttttattcattttagagtaaactccacatctttgcactacctgtttgcctccaagagactatcagttccttggggacagggaccatgtcttattcatctttgtgtctccagcatctagtacagtgcctggtatatagtaggtgctcaataaatgttgaaaccaactgaactgccaacaaaataaaaataaaaagtcttcactatgtagcataccttcccttgtccaagttctgaagaggttttttttttttttttttaatagaaactgaagacattttacaaccagctatgacttggtaagacattcttagaattttaggtgtcactgataatcctagaaccactgagccccaagtgaagaatttaacaacaaaatgggttaatgaaaaatataattacattgtatatttaagtttcatagaattatttaaaacaacacattaaagatttttctaaaatat

SEQ ID NO: 6963 - DNA, 619 bp, Homo sapiens
cgtctctctgtggttcagtcacatttggggtaaaactggaaccgaagccctatagggtcccctgagggagagagtgggcatcgggcagccggggaaccgctttagtgataactttgactgcggttcccaggcggtgcagggtcagcggctcgcgccccggcgcgcgggctctctttttctctttctttctttccctctctctctttctaaacgaaggagcggtcggcgcgctaatgcatgagaaagagcaacttttcttaatttccaatcttggagacagcttttaatcagtgcgagacgcagagaagataaaaagagggtgatcggtttcacagggtccatggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctg

SEQ ID NO: 6964 - DNA, 2382 bp, Homo sapiens
atggagggaagcccatccctgagacgcatgacagtgatgcgggagaagggccggcgccaggctgtcaggggcccggccttcatgttcaatgaccgcggcaccagcctcaccgccgaggaggagcgcttcctcgacgccgccgagtacggcaacatcccagtggtgcgcaagatgctggaggagtccaagacgctgaacgtcaactgcgtggactacatgggccagaacgcgctgcagctggctgtgggcaacgagcacctggaggtgaccgagctgctgctcaagaaggagaacctggcgcgcattggcgacgccctgctgctcgccatcagcaagggctacgtgcgcatcgtagaggccatcctcaaccaccctggcttcgcggccagcaagcgtctcactctgagcccctgtgagcaggagctgcaggacgacgacttctacgcttacgacgaggacggcacgcgcttctcgccggacatcacccccatcatcctggcggcgcactgccagaaatacgaagtggtgcacatgctgctgatgaagggtgccaggatcgagcggccgcacgactatttctgcaagtgcggggactgcatggagaagcagaggcacgactccttcagccactcacgctcgaggatcaatgcctacaaggggctggccagcccggcttacctctcattgtccagcgaggacccggtgcttacggccctagagctcagcaacgagctggccaagctggccaacatagagaaggagttcaagaatgactatcggaagctctccatgcaatgcaaagactttgtagtgggtgtgctggatctctgccgagactcagaagaggtagaagccattctgaatggagatctggaatcagcagagcctctggaggtacacaggcacaaagcttcattaagtcgtgtcaaacttgccattaagtatgaagtcaaaaagctggggaaaattctgcgaagcccttttatgaagtttgtagcacatgcagcttctttcatcatcttcctgggtctgcttgtgttcaatgcctcagacaggttcgaaggcatcaccacgctgcccaatatcacagttactgactatcccaaacagatcttcagggtgaaaaccacccagtttacatggactgaaatgctaattatggtctgggttcttggaatgatgtggtctgaatgtaaagagctctggctggaaggacctagggaatacattttgcagttgtggaatgtgcttgactttgggatgctgtccatcttcattgctgctttcacagccagattcctagctttccttcaggcaacgaaggcacaacagtatgtggacagttacgtccaagagagtgacctcagtgaagtgacactcccaccagagatacagtatttcacttatgctagagataaatggctcccttctgaccctcagattatatctgaaggcctttatgccatagctgttgtgctcagcttctctcggattgcgtacatcctccctgcaaatgagagctttggccccctgcagatctctcttggaaggactgtaaaggacatattcaagttcatggtcctctttattatggtgttttttgcctttatgattggcatgttcatactttattcttactaccttggggctaaagttaatgctgcttttaccactgtagaagaaagtttcaagactttattttggtcaatatttgggttgtctgaagtgacttccgttgtgctcaaatatgatcacaaattcatagaaaatattggatacgttctttatggaatatacaatgtaactatggtggtcgttttactcaacatgctaattgctatgattaatagctcatatcaagaaattgaggatgacagtgatgtagaatggaagtttgctcgttcaaaactttggttatcctattttgatgatggaaaaacattacctccacctttcagtctagttcctagtccaaaatcatttgtttatttcatcatgcgaattgttaactttcccaaatgcagaaggagaaggcttcagaaggatatagaaatgggaatgggtaactcaaagtccaggttaaacctcttcactcagtctaactcaagagtttttgaatcacacagttttaacagcattctcaatcagccaacacgttatcagcagataatgaaaagacttataaagcggtatgttttgaaagcacaagtagacaaagaaaatgatgaagttaatgaaggtgaattaaaagaaatcaagcaagatatctccagccttcgttatgaacttttggaagacaagagccaagcaactgaggaattagccattctaattcataaacttagtgagaaactgaatcccagcatgctgagatgtgaatga

SEQ ID NO: 6965 - DNA, 1527 bp, Homo sapiens
cgggggtttcccaggtgactttgcgaaggcatggcggggacactgtgaatgtcagcccagaaggtgatcagagcctgttaattaaaatggaaagaagacagaagggaaggtagacatcaggttctccctggagacttttcgttttcatttacgctgcggaaactgacgtttttgcctaacaccccatgtaatgtaaacgtataggcttgagtacgtgtccggccgcatgtgtagtgaaccctaaagctttcctaattgtagttagcatcgtccctaagcggaacgattttccgtgaacatgatttgtacttttctacgagccgtacagtatacggagaagctgcacaggtcctcggcaaagcgattgcttttgccatacatcgtgcttaacaaagcgtgcttgaagactgagcccagtttgagatgtgggcttcaatatcaaaagaaaacgctgcgacctagatgtattcttggagtcacccagaaaaccatctggacgcagggaccgagcccccgaaaagcaaaggaggatggcagcaaacaagtgtctgtgcacaggagtcagagagggggaaccgccgtcccaacatcacaaaaagtgaaagaagccggaagagattttacctatttaatagtggtgctttttggaatcagcattacaggtggcttgttttacacgattttcaaagaacttttttcttcatccagtcctagcaagatatatgggagagccttagaaaaatgcagatcacatcctgaggtgatcggtgtctttggtgagtctgttaaaggctatggggaggtgacaaggcggggtcgccggcagcatgtcaggttcactgaatatgtaaaagatgggctgaaacacacgtgtgtgaaattctacattgagggctctgagccagggaagcaaggaacggtgtatgcgcaagtgaaagagaacccaggaagtggtgaatatgattttcgatatatatttgtagaaattgaatcttatcctagaagaactattatcattgaagataatcgatcccaagatgattaaaatagggtttctgatggatgttgaatggcgtggactcgctactccgttcttcacagctgccttccagaatgtgttcaaaagaaagacaagaaggagtgtatggcttataaagtgaatctaatacagtatttgttgcatttaaacaaactagacattttcttacggaaaaattatgaaatacagcatattttatgttctcccattgactcaatcatgacaatatttctgctttaacaccatctttcatgattagaaatgtttgttattggaaatgttacaccatgtaaataaaggaaatagattttagtattgtattcattttatattatagaactgcataatgtctgcagaataaaattaaaactaacaaatatgtcattagcagctgccctccgcatactttggaatctgacttgagataagcatgtgaaaatggttgagggccatagggaaccagatggtaaatacattcttcaaaattg

SEQ ID NO: 6966 - DNA, 508 bp, Homo sapiens
aggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacag

SEQ ID NO: 6967 - DNA, 638 bp, Homo sapiens
gaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacag

SEQ ID NO: 6968 - DNA, 1156 bp, Homo sapiens
gtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgcgatacagatgagtttattttacctaccggagctaataaaacccggggcagatttgagctggccttctttacgattggaggatgttgcatgacaggggctgcgtttggtgcaatgaatggtcttcggctaggattgaaggaaacccagaacatggcctggtccaaaccaagaaatgtacagattttgaatatggtgactaggcaaggggcactttgggctaatactctaggttctctggctttgctctatagtgcatttggtgtcatcattgagaaaacacgaggtgcagaagatgaccttaacacagtagcagctggaaccatgacaggcatgttgtataaatgtacagcctcggcctcccaaggtgccgggattgcagatggagtctcgttcactcagtgctcaatgttgcccaggctggagtgcagtggcgtgatctcggctagctacaacctccacctcccagccgcctgccttggcctcccaaagtgccgagattgcagcctctgcccggctgccaccccgtctgggaagtgaggagcgtctctgcctggccgcccatcgtctgggatgtgaggagcccctctgcccgggctgcccagtctgggaagtgaggagcgccttttcccggctgccatcccgtctaggaagtgaggagcgtctcggcccggccacccatcgtctgagatgaggggagcgcctctgccccgccgccccgtctgggatgtgaggagcgcctctgcctggccgcgaccccgtctgggagtgtcagagatggctttggattccccgttctgtgtgctgctgtctggctcctgaacccagctgtagaggtgtgtgtcaatcccaactggtgaagtactgagaagaagctacacaaaaggcagcaaagtattagtaagtgtacctctgacattttaaccacctctgactttt

SEQ ID NO: 6969 - DNA, 509 bp, Homo sapiens
ccggcgcccggaaggtcagcgtgtgaagtaggcgctggcaacgcggggttacccgctgttattgaggagtaacggcccagcggaccacccaggcttgaggcagcggcgggaaccactcggtttgctgcgataccatggaaggaggcgggggaagcggcaacaaaaccacagggggattggccggctttttcggagccggcggagcaggttactcgcacgcggatttggctggcgtcccgctaactggtatgaaccctctgtctccttatttaaatgtggatccacgatacctcgtgcaggatacagatgagtttattttacctaccggagctaataaaacccggggcagatttgagctggccttctttacgattggaggatgttgcatgacagctttgctctatagtgcatttggtgtcatcattgagaaaacacgaggtgcagaagatgaccttaacacagtagcagctggaaccatgacaggcatgttgtataaatgtacaggtgag

SEQ ID NO: 6970 - DNA, 2572 bp, Homo sapiens
acaggtgtggaggggcaacccatcccttcagacaattgggaggtgagggccgattgccttacacggtgagacaagcggcctgactcgtgactatttttttggacaaatcaggcagccactgactcccttcattatggcctcagctttatctctgggcaataagtgtgatcccttccttcgctgcgtcctttgcaggggcggtggcgctctgcaaggcccaagggggcgtggtccagatgactttgaatcccagttgtcgcccccagggtcagccaggagactagtcagaagcaaacgcgcctgcggcaatccgcccgatgcctttggtctctctcgggcttccgtccacccgcccctcccccgcgtttccattggctgtagctccggcccggggcgggcgaagagggagcgagtgggcggggccgcgtggcgtcagcgcaagatggcggcctcggcagcggtgttctcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatccaattctggtacagcagttgcgccggacatacaaatatttcaaagattatagacagatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgccacacctgctgtgtcccgagagtctccagatgggggcatcagggtgaggtccgggactcttgggtcatcgtcccacagtggctgatcggctgccaagcacagtgggggtgctttgttggatcagagcagatttttcaccctggtctcggaatctaaaaaccctcgctgtgtcttcctgtgtgttgcgtgatctgtgaaaaatacatctccctctgaccacagactcctcatctgtggagaagggaagagaggatggcacttggctttaaagacaggtagctgccaggctactgtggagagaatgtgttatgggcctagtgggcctctggtggaccagagattacccctctcaacaggccagctgctggttggctccagccagtgtggccctggggtaaagggggcctggagttgcttgacacgccagttgttcaaaagaagcaagaacttgggaatattttttttttttttttgagacagggtctcactgttgcccaggctggagtgcattgatgtgatcttagcttacaacagccttgacctcccggctcaagtgatctccaagtgaccctcctgcctcagcctcctgagtaccctcctggggactacaggtgcgtgctaccatacccagctaatttaaacaaattttttttttgtagagatggggtcttggtgcccaagctggtctcaaactcctagtcttaagcaatcttcctgctttggcctcccaaagcgctaggattccaggtgtgagctactgtgcccagctaaaatagggatttttatattaaatctccctattttaaaatgttggctcctagcggggcgcagtggctcacgcctgtaatcccagcactttgggaggctgaggtgggtggatcacctgaggtcaggagttcaagaccagcctcaacatggagaaaccccatctctactaaaaatacaaaattagctgggcgtggtggagc

SEQ ID NO: 6971 - DNA, 1080 bp, Homo sapiens
tcgcgcttgcgaagcgggctccggctcggctcgcggggactgtgcacgaggttggcgacgccgccccgccgggccccagatcaggccgcagagatcgggagccgcgggagcactaaggcgcaagggccacagcagcagccgggctcagagggtcccagctatgccaaaaaagttgcgctctggcttgctgggctgcttggagctggtgggactgtgagcgtcgtctatatctttggaaacaacccggtggacgaaaatggtgccaagattcctgatgagttcgacaatgatgatcatcgagcccaccagcccttgccttctcccagaccctctgcaggaaccgtactaccagccaccctacacgctcgttttggagctcaccggcgtcctcttgcatcctgagtggtcgctggccactggctggaggtttaagaagcgcccaggcatcgagaccttgttccagcagcttgcccctttatatgaaattgtcatctttacgtcagagactggcatgactgcgtttccactcattgatagtgtggacccccatggcttcatctcctaccgcctattccgggacgccacaagatacatggatggacaccatgtaaaggatatttcatgtctgaatcgggacccagctcgagtagtagttgtggactgcaagaaggaagccttccgcctgcagccctataacggcgttgccctgcggccctgggacggcaactctgatgaccgggtcttgttggatctgtctgccttcctcaagaccattgcactgaatggtgtggaggacgtgcgaaccgtgctggagcactatgccctggaggatgacccgctggcggctttcaaacagcggcaaagccggctagagcaggaggagcagcagcgcctggccgagctctccaagtccaacaagcagaacctcttccttggctccctcaccagccgcttgtggcctcgctccaaacagccctgaactctgggcctcctcaaactcagtgcctgggtccagggccccagtgcttccagaccaagacttgggccaccacttgtccaataaagtacatcccagacgcc

SEQ ID NO: 6972 - DNA, 819 bp, Homo sapiens
tcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggcaaaaaaaaaaaaaaaaa

SEQ ID NO: 6973 - DNA, 805 bp, Homo sapiens
aagtcgagaggcggtgcacacccgtcgcgcatgcgcaaacacagctgtcggaaggtggcgagcctgaggcgaacaatggcggagctgggcgaagccgatgaagcggagttgcagcgcctggtggccgccgagcagcagaaggcgcagtttactgcacaggtgcatcacttcatggagttatgttgggataaatgtgtggagaagccagggaatcgcctagactctcgcactgaaaattgtctctccagctgtgtagaccgcttcattgacaccactcttgccatcaccagtcggtttgcccagattgtacagaaaggagggcagtaggccatcccccaggagaatgacagaagcaaaggacttgttactaagcagatttaagggtcagtgggggaaggctatcaacccattgtcagatcagcatcaggctgttatcaagtctgttggtgctaaaaagtaaaagatgaaatgttcaaagagtgaaatttatttatttggaattcagaaattccaggttgtatgacatcagttactcaataagtgtgaattctccaactcttcttttaatcccattttagaatttaatatagagatctctgattggcaggaacactagaaataaatgttccatggccagtagtgcaaatgggggattgtaggttttgaaaaaccaccctaagccatattaagggggttggaagaaccatcgaagcctaaggcatagaagaaaatttggggttaagaaagatgaagaacaaaaaacagctttattgcttatacatgaccaagaaaaggaaaacatggc

SEQ ID NO: 6974 - DNA, 2394 bp, Homo sapiens
ggcgggacttcctgtgtcgtatttccaaggactccaaagcgaggccggggactgaaggtgtgggtgtcgagccctctggcagagggttaacctgggtcaaatgcacggattctcacctcgtacagttacgctctcccgcggcacgtccgcgaggacttgaagtcctgagcgctcaagtttgtccgtaggtcgagagaaggccatggaggtgccgccaccggcaccgcggagctttctctgtagagcattgtgcctatttccccgagtctttgctgccgaagctgtgactgccgattcggaagtccttgaggagcgtcagaagcggcttccctacgtcccagagccctattacccggaatctggatgggaccgcctccgggagctgtttggcaaagatgaacagcagagaatttcaaaggaccttgctaatatctgtaagacggcagctacagcaggcatcattggctgggtgtatgggggaataccagcttttattcatgctaaacaacaatacattgagcagagccaggcagaaatttatcataaccggtttgatgctgtgcaatctgcacatcgtgctgccacacgaggcttcattcgttatggctggcgctggggttggagaactgcagtgtttgtgactatattcaacacagtgaacactagtctgaatgtataccgaaataaagatgccttaagccattttgtaattgcaggagctgtcacgggaagtctttttaggataaacgtaggcctgcgtggcctggtggctggtggcataattggagccttgctgggcactcctgtaggaggcctgctgatggcatttcagaagtactctggtgagactgttcaggaaagaaaacagaaggatcgaaaggcactccatgagctaaaactggaagagtggaaaggcagactacaagttactgagcacctccctgagaaaattgaaagtagtttacaggaagatgaacctgagaatgatgctaagaaaattgaagcactgctaaaccttcctagaaacccttcagtaatagataaacaagacaaggactgaaagtgctctgaacttgaaactcactggagagctgaagggagctgccatgtccgatgaatgccaacagacaggccactctttggtcagcctgctgacaaatttaagtgctggtacctgtggtggcagtggcttgctcttgtctttttcttttctttttaactaagaatggggctgttgtactctcactttacttatccttaaatttaaatacatacttatgtttgtattaatctatcaatatatgcatacatgaatatatccacccacctagattttaagcagtaaataaaacatttcgcaaaagattaaagttgaattttacagttcgtatattcatgtggtcctttgaaagggtattctagaaatcactggaaagaggagaggaaagaaccaggtaggcaaatggtctgtgaaacccttgggtcctggaagcagtgtgagtgtaaatgtgtagtgtttggtttcatctaaataaacaaagatgatttctttgacacttgaaataaaatacaaattcaacaaaaagtagatcagcattattaaagaaacggttcaactttgtttcttcccttagtattgctgacaaagtatctgctgtagaatacaggaattacttagaatagaaacatagtcatcacaactgttactaaatggaaaagaaaagaattattgagttaagtattcctgtcaatacgggaaacactgctagtaccttatgttggtgttagacctctctgccctacactgagaatatagttttacacaggagcaaggtttgtgaagcagcatagtgaggtagctaaagccatgggctggctctaaaggctttaaatcccagccatgtggcttagctgccatgagatgtgcatttgagaaatgttgtcttcttttgctgttcaactccagattttcagatgataatgtgattatcccagcttaagttgcgtccacttctggtctagtgaattgtggaaggcagttttagagaaaggagtcatgagtaacatgaacagcagttggctatgtctttccagttctctgctgatgtcagaaagacccagaaataccaaggagaaaaagccatcttagggatctaaggaggccctatggaaagttactaccttagacatttgaagatagcttactgcttagtacatacactgtaaacaacgatctcattttaaatgagaactttctcataaatattttacaaatgaggtcaaactagcataaagccatttaaagagattatcagtccaatatgaaccagttaagtctttggactatccctttcctccttgactactgctttgacgtacctaaatcattcgtct

SEQ ID NO: 6975 - DNA, 3387 bp, Homo sapiens
gcaggcgcaggagccgcgctctgggcctctgctcaggctctgccgcggacgacctcgaggcccttagttgactgggaccggaagtggcgtgtgctcggcctttctgtgttcctggcccgcggccgtcgggtgtgagctgcgccgaccgctctgagggttcgtggcccaccgctccttcgcggtccctgccgccaccgtccacgctcagcgttgtagagaagatggtgggtcggaacagcgccatcgccgccggtgtatgcggggcccttttcattgggtactgcatctacttcgaccgcaaaagacgaagtgaccccaacttcaagaacaggcttcgagaacgaagaaagaaacagaagcttgccaaggagagagctgggctttccaagttacctgaccttaaagatgctgaagctgttcagaagttcttccttgaagaaatacagcttggtgaagagttactagctcaaggtgaatatgagaagggcgtagaccatctgacaaatgcaattgctgtgtgtggacagccacagcagttactgcaggtcttacagcaaactcttccaccaccagtgttccagatgcttctgactaagctcccaacaattagtcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaacttacctctactgttagactaggcgactcacatttgaggacttttctcgggtatcttgagggtttgtgatcctgaacccttaaacagtgcttttttgttacacaggagggcttttttggggggatgaccagtacagacatgccagttagttttactagtgggatcccaaatccaaagcagtgtagtggtgattggtcagtgactaaccaggcagctaagaagtcttaggcagcagcccagacatgtatagaggggcagttagagggagaacaggggtgggaaagggagcaaggggcagatagctcagcaaggaaagaatgggctcagaaaaaggagggctggctggaggagtgaggggcagcttaagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaactttg

SEQ ID NO: 6976 - DNA, 620 bp, Homo sapiens
ggcccgcgcccaacgctcggcttgtgggacgcccgcggtcggatgccctccgtccgctccctcctccgcctcttggccgccgcggcggcctgtggcgccttcgccttcctgggctattgtatttacctcaaccggaagcggcgcggggaccccgcgttcaagcgccgcctgcgggacaaaagaagagcagagcctcaaaaggctgaggagcagggcacgcagttgtgggatccaacgaagaataaaaagttgcaagaacttttcttgcaagaggtacggatgggagaactttggttatctagaggagagcacagaatggggattcaacacctcggcaatgcccttttagtgtgcgagcaaccacgggaacttctgaaagttttcaaacacactctccctcccaaggtatttgagatgctgttgcacaaaattccccttatttgccagcaatttgaggcagacatgaatgaacaggactgcttggaggatgatcctgattgaaaaacatttcaacgtatccacagtccagtgagaatactatggtaccatacagtataaacaactgctcagtgatatttccatttattttactttgagtaataaaaatttttctatctcat

SEQ ID NO: 6977 - DNA, 2062 bp, Homo sapiens
gctccgggcctccaggtctcgcaggccccgccccctcgccgcgggttcgctgttgggcggagatattcgccgccggcgcttgcgcccggaaggtgtgccgcaccacacgggggaggaaggaaggagctcccaactcgccggcctggccacgggatggcccccaaattcccagactctgtggaggagctccgcgccgccggcaatgagagtttccgcaacggccagtacgccgaggcctccgcgctctacggccgcgcgctgcgggtgctgcaggcgcaaggttcttcagacccagaagaagaaagtgttctctactccaaccgagcagcatgtcacttgaaggatggaaactgcagagactgcatcaaagattgcacttcagcactggccttggttcccttcagcattaagcccctgctgcggcgagcatctgcttatgaggctctggagaagtaccctatggcctatgttgactataagactgtgctgcagattgatgataatgtgacgtcagccgtagaaggcatcaacagaatgaccagagctctcatggactcgcttgggcctgagtggcgcctgaagctgccctcaatccccttggtgcctgtttcagctcagaagaggtggaattccttgccttcggagaaccacaaagagatggctaaaagcaaatccaaagaaaccacagctacaaagaacagagtgccttctgctggggatgtggagaaagccagagttctgaaggaagaaggcaatgagcttgtaaagaagggaaaccataagaaagctattgagaagtacagtgaaagcctcttgtgtagtaacctggaatctgccacgtacagcaacagagcactctgctatttggtcctgaagcagtacacagaagcagtgaaggactgcacagaagccctcaagctggatggaaagaacgtgaaggcattctacagacgggctcaagcccacaaagcactcaaggactataaatccagctttgcagacatcagcaacctcctacagattgagcctaggaatggtcctgcacagaagttgcggcaggaagtgaagcagaacctacactaaaaacccaacagggcaactggaacccctgcctgaccttacccagagaagccatgggccacctgctctgtgcccgctcctgaaacccagcatgccccaagtgagctctgaagccccctcctcaatcccttgatggcctcccaccctgtaagaggctttgcttgttcaaattaaactcagtgtagtcaaacacagacatggttgttgcaccagaaaggtccccactagagctaagcgtgaagctgaagctctgtccctattcccccagcccagctagctgatcacaccaacagatcctcatcagcaaagcatttggctttgtcctgcccaagtgggctgcagactgagtgctgcccttgtagcttccccagaccccaactcactgcagttcatctgaacaacctgagctcctgggccggggtggaaggagggggataaacctaaggccctgatccaaagcagcctgttgagctggttctccagggctgcagtctctccaggtgtacagctgctgtccctgccctgtcctgtccttgcacagtctcctatgtctgagccccagtgccttctgttcgggccctcctttggtgggaaggcagagccctgacccttgaatggttgtccttgactctgtgctgctgccttctgcagagaggcacctaagctgtttaaagagcccagtgattgtggctgctcctcctagaggtgggagggggcaagaggcctccttggtcagtgtccatgctttctgggcagggacttggttttttgttccaacagtggccttctccgggcttcatagttctttgtaatatgttgaagttaatttgaattgactgattttgttgaactgtgtgtttaagctgttgcattaaaaagctttcttctacatcaatatctgctgtgctttcatttatgccttttcagctttgcacctggaactctgtagtaataataaaagttattgcttattgggcattca

SEQ ID NO: 6978 - DNA, 2636 bp, Homo sapiens
ctagggttgtctctccatgagtgctctccttccctactcttcctgttccaggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaagtgagatgaaa

SEQ ID NO: 6979 - DNA, 2708 bp, Homo sapiens
ttcaaagatggcgcttacggccacgctaagaatgcagcgtgaagctgcagttctgccatcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaagggagaaggattaaggggtatggctgaattcccccggcaccccttgccctcaggcttccttcttcctttccctttggttaatcctgcatgggattagctgaccatcctgttttccatcccagagcctcccaaggctgggaaagtagggctgaagggctagatgtttggtctcaggaagtggggcccacccattcccagaaggagcttctttacctcttagccctgaggtttcctccttcccatcttctgtgcttccagagaacaactttgttcctatggtcacccccactatccccatgaccgcatgaagaggcagttattgctttagtctttcattgcaaccactgggctccctttgaacccggcccaatctttggtcccagcattttcccactccagtgtatccagggtgttccaggtgagctggggaaggaagtgagcatggcctcagctgcagatctcctggagcagcggcatcatggcagacaggccctggatgtgctggatttggtacccgtaggcctcattaatgctccggagctcagccagcaggcctagcaacttcgcatacagaaacctttggaggaagtagtggggttgccaggaaaacaggagggaaataaggcagttgggagtcttgtctctaggccctgatcccctgaactattcctcagtgaagccaggtctgaacattagagaaaatcatgctctggtatgacagactatcagaggttccaaaggtcctccagggggcctcggtctgacactgtcttctctcaccatgctcagttttttctgaacccagagctctgagagccgagtgtgaagaaagctccagacttggccagaactccaaccatgtggaatctgagggcctggccttctagagcaggttctagaaggtggatgtgttctatggtataaagcatcccctttctggccaaactagctcttggaggaacgagcaaaacagaagcggtgcatacctcagagcctggataaatcacagactattgaacctggaactggctttgaccatgaaactgtgaatggccctaacttcaagggaaatgagaaatcgaaggaattggcccaatggcgaggagaggaaaggccaagggaagagaaaagtctgcgttagtctggagaagttggactagtgaggtaatggatgtcatcaatctcaggaatgctattacccagagcctctgagctactactttgcatctgtactgaataaaaaaaaaatctggaaaaa

SEQ ID NO: 6980 - DNA, 1165 bp, Homo sapiens
aagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaaggtggcgcacactatacacatgagtgccctgggcttgccgggatatcacctccatgcggcctatgcaggggattggcagctcagtcccactgaggtgttccccactgtggtaggggatatggacagcagtggcagcctgaacgcccaggtcttgctcctcttggcagagcggctccgagctaaggctgtcttccagacgcagcaggccaagttcctgacatggcagtttgatggcgagtatcggggagatgactacacagccactctgaccctagctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccacaggggcagttgatgaggcagaggtttgaggatcccccctctgctaccagccccagtatcaccttccccatgctcttgtggctgtggactaa

SEQ ID NO: 6981 - DNA, 1201 bp, Homo sapiens
atcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaagatgtattcccagcacagatggagggagtgaagctcgttgtcaacaaggttctgagcagccatttccaggtggcgcacactatacacatgagtgccctgggcttgccgggatatcacctccatgcggcctatgcaggggattggcagctcagtcccactgagacgcagcaggccaagttcctgacatggcagtttgatggcgagtatcggggagatgactacacagccactctgaccctaggaaatcctgacctgattggggagtcggtgatcatggttgctcacttcctgcagagcctcactcatcggctggtgctgggaggagagctagtttatcaccggcggccaggcgaagagggggccatcttgacactggctgggaagtactcggctgtacactgggtagctacattgaatgtgggatcaggcggggcccatgcaagttactaccacagggcaaatgaacaggttcaggttggagtggagtttgaggcaaacacaaggctacaagacacaacattctcctttggttaccacctgactctgccccaggccaacatggtatttagaggcttggtggatagtaactggtgtgtaggtgctgtgctggagaagaagatgccccctctgcctgtcaccctagcccttggagccttcctcaatcactggcgcaacagattccattgtggcttcagcatcactgtgggctgaggttgtccagagccagcccccacagcagctggaacctctgagtcaggtgccctagggccaaagactaggcccctcttcagagcccaccttgctgggtgatctctaggacccaggagcagagtggtggacaggaccatgccctcctcagaactggagctgccaca

SEQ ID NO: 6982 - DNA, 751 bp, Homo sapiens
ggcaacgagagggcgggaacaggaagtgaggataggccgagttccgggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcactccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 6983 - DNA, 808 bp, Homo sapiens
gggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacgctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggtataattgtaaataatgtcaaactccgttttctagcaagtattaagggagctgtgtctgaaatggcactgtcttgtcagtcatttctgtttacctttttcttctgcccagagtgtatttgtgaagagtctcttatattatgttttgtggaaatcagcacacaaccacaatgacatttaagcacaggatcattattagtctatgtttttaataaacatatcaattaagaaaa

SEQ ID NO: 6984 - DNA, 635 bp, Homo sapiens
ggcgcgaggcggccaccgtggagagcagagcgcggcggctggaagctgctaagtcagagccgcgatgttccggattgagggcctcgcgccgaagctggacccggaggagatgaaacggaagatgcgcgaggatgtgatctcctccatacggaactttctcatctacgtggccctcctgcgagtcagtgagtgtctcccgggctgtgactgtgagaccagcggggagctcaccgacgggcaccccttaactctaaggggtcatcggggccttcgaactgagctgaacggtagcggggagcaaggagggtgcgcgttgaaggcgacgggcatatgcgcggtttgagctccatttatcttaaagaaattggacagcatatgaagacaggacatcacatatgaatgcacgatatgaagagcctggttacagtttcgactcctctctgcaagtgaataggcccagaaaggtgtaagagactctttgaatggacataaaattctgcttgttaagaacaagtttggctctggtaactgaccttcaaagctaaaatataaaactatttgggaagtatgaaacgatgtctcgtgatctggtgtacccttatccctgtgacgtttggcctctgacaatactggta

SEQ ID NO: 6985 - DNA, 595 bp, Homo sapiens
tcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcag

SEQ ID NO: 6986 - DNA, 637 bp, Homo sapiens
ggttcctccaccgaggcccatgcgaagctttccactatggcttccagcactgtcccggtgagcgctgctggctcggctaatgaaactcccgaaataccggacaacgtgggagattggcttcggggcgtctaccgctttgccactgataggaatgacttccggaggaacttgatactaaatttgggactctttgctgcgggagtttggctggccaggaacttgagtgacattgacctcatggcacctcagccaggggtgtagccaagtagttctaatgccacctgtcgtcttatcatctgattgcagacaaatggaatcctgtgctgaacccgaatcttccaaaaaacagcctacaatctgtgaccaccacaagatgtgccctgatggcagctgaagtttgattcagatgggcacttttcttccccttccctgcctagtttccttttgttccttgagtccacgcagaattccattctctggtcagcagacaggcttaagctaaagtattgcctctattctgtaaagttctgtacatagttcccaagcttctgcagggggtgatttttgctcttgtcctgagaaataacagtgctgttttaaaaaacatttgaaataaataccgcacacaaaggcagtc

SEQ ID NO: 6987 - DNA, 778 bp, Homo sapiens
ctcctttccctttcggattcccgacgctgtggttgctgtaaggggtcctccctgcgccacacggccgtcgccatggtgaagctgagcaaagaggccaagcagagactacagcagctcttcaaggggagccagtttgccattcgctggggctttatccctcttgtgatttacctgggatttaagaggggtgcagatcccggaatgcctgaaccaactgttttgagcctactttggggataaaggattatttggtcttctggatttggaggcaatcagcggacagcatggaagatgtgtgctctggctcggataagagatgggacatcattcagtcactagttggatggcacaaggctcttcacagacgcatctgtagcagagtggaacttgtactaacttatgatagaatgtatcagaataaatgtttttaacagtgttatgcttgagtcttttttgaattgaacatgctaggattatcaggtaaaaattaagccttttggtactttctcaaaacagggaatttatgtgtgtacctaggtgctatttaagcctgtaaatcccagcactttgggaggccagggcgggtggatcacgatataaaaaaatttttccaagttattcctgcccattgacctaacatatggattacagtttccctttgcagtgaattaataactccttctaggatattccgaggtagtaagaatacagatagttctgtttgtgacaaaccaagctgttacttcctcctctgcattaaagttctgactgcaagaaa

SEQ ID NO: 6988 - DNA, 4409 bp, Homo sapiens
cttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactggaggagaaggacggccaggtctggcccggcatgccctgggcttccggtgacctctggcccttttctgtcgtccgctctctctgcctagcgtgctcgctcgctcattgctttccttccctccctcggtcttccttcgcacgctgtttggtgattgtggcgctcgcgacagacagggaggcggtggcagaggacacttgtcatggccgcctctaaacctgtggaggcagcggtggtcgcagccgctgtaccgagctccgggagtggggtgggcggcggcgggactgcgggcccgggcacgggggggctgccgcgatggcagctggctctggcggtcggggcacccctgctgctgggcgcgggtgccatatacctgtggagtcggcagcaacggcgccgggaggccagaggccggggcgacgccagcggcctgaagcgcaacagcgaacggaagaccccggagggcagggccagtccggccccgggcagcggacaccctgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttgaaggaagtttgcagtcttgcagcttttattccctgtgcaacaaaagattagaacatgttaaagggatttttaaataaagttgcaaagagtacaaatgataattggccatgcaaataaaaactgatttgttgattttttttttaaggggggttggcagttgattatgttctggatgattccgtctatatatgtgtgaataatgtaagtattttacagcatgttgatttttaaattaacgtagtaaatgctgtaaaatagatttatattcagttaaccgctttcagttgattttttgaaagaaacaaaggttaaatgggggattaaagtaaaattgagagaccctttaaaccattgtcagcatgcacaatgcctctgattctgcagttttagaaacttggtggcacttattaatcctcttggcccctttccactctaatggatagtgtacattcttcttaaagtccacaacagcagattttcttgcagtaaattatgcagatgcaaaatattctaattgatatatgtgttggaagactgagtattgatgggggagtggaccagacaaagaggtaagatgaaacagtagtgtgtttataattgtctgtgactattttctataataattagtactatttaatggtgagcttttaaaaatgtaggatagagggtacagtggcactgtatatactatttatagtctcagctactagggaggctgaggcaagaggcttgagaccaggagctcgaggctgtaatgtgccatgatgattgcacctgcgaatagccactgcactccagcctgggcaatatagcaagaccccatcctttaaaaaattttagaacttttttaaaatcaaagtgcagattgcttgtatgtaaaacccaaataaaggtagagtaagtgtgatatatgggagtattaaaatagcttaaaatttctcgtgaaggacatgtggctaaagggtcaaaaaggatgtaagacttggagccagagcatagtatttcctgaaataacaagtttagtgctttaactatggctacatgtgcttaaggaattttgagccacttatttttgaagatgctgaggacatgtagagtgctttttgtagtgagctaaccttgatctctaaggactaactacccaggtccaggtcttcactaggggtactgacagtgtttaagctttactccacctccttacttagaaatcactttacgatttatttccattttccacttttatagaccatccttttgcttatatgctagatttttctggtgagggaagggttgtgttcttcaggggtcttttgttttgaaatactcaggatggggagaggtttatttaagaacgaattataattatggtttacactgttgggagtaaaggagcatttttacaccccttaagggtgcttaattctgttgaaaccaaaaagatttgtctacaaatgctatcttttttagaaactattagaaatgactccctttcaaagtcaatctttggaaaatattgaggaggtcactaattagttggtgcagttaatataattcaagatgatttggatgatgggaagtttgagaccgctgcattttgtttttaaattatgcaccttctgataacccccaaatacagaaatgttctacatctctgaatgacctctgactttaaaaaagtttttatttgcatggctgtatttacattaacactgacattttcttctactcttctcccttctttcatcttggggttgggtagagaaacacaaaggaaactgaagcatgtgccattctatactgtcattccaaattctcatggactattgcctgttgtgaaaatgtttgaaactgcactgaaagctgcatctgtctgtatctttcttttgtaaatgacctcacatgtaaattcaccaaataaatattacattcaagctcttctatctattctttaaatagaaagata

SEQ ID NO: 6989 - DNA, 1990 bp, Homo sapiens
attccagtgctgtgccgctgctttttcttccactcggatctcttgagcgcccttagcccgctgtatacgcgcccctcctcggcttcagtaggcaagagggccatctgcccttctttcctgaaggtagaggggacaacaccagctacgacggggactccagaagtccatctcccgaacagcagcggggcgaaaagaaagaaaaagggtttccgaagactcctactcacacccacgctttcccttaacccggaagtgatttccgcccctcctctccctcttcggttgatactgaaggtcccggtgctcacttggacatgaactctcttgatagagcccaagcagccaagaataaaggcaataaatattttaaagcaggaaaatatgaacaagctattcagtgctatactgaggctattagcttgtgccctacagagaagaatgttgacctttctacattttatcaaaacagagctgctgcctttgaacagttgcaaaaatggaaagaagtggcacaagactgtacaaaagctgttgaacttaatcccaaatatgtgaaagctctctttagacgtgcaaaagcccatgagaagctagacaataagaaggaatgtttagaagatgtcactgctgtgtgtatattagaagggttccaaaatcaacaaagcatgctgttagccgataaagttcttaaactccttggaaaagagaaagccaaagaaaaatataagaatcgtgaacctctgatgccatctccacagtttatcaaatcttacttcagttctttcacggatgatatcatttcccagcccatgcttaaaggagagaaatctgatgaagataaagacaaggaaggggaggctttagaagtgaaagaaaattctggatacttaaaggccaaacagtatatggaagaagaaaactacgataaaatcataagtgaatgctcaaaagaaatagatgctgaaggcaaatacatggcagaagcattgctactacgagctaccttctacctgcttattggcaatgccaatgcagccaaaccagatttagataaagtcatcagtttgaaagaagctaatgtgaagcttcgagcaaatgctctcatcaaaagaggcagcatgtacatgcaacagcagcagcctttgctgtccactcaagattttaacatggctgctgacatcgatcctcagaatgcagatgtttatcaccaccgaggacagctgaaaatactccttgatcaagttgaagaagcagtggcagattttgatgaatgtattaggttaagacctgagtctgctctggcacaagcacagaaatgttttgcattgtaccgccaggcatatacgggaaacaactcttcacaaatccaagcagctatgaaaggttttgaagaggtcataaagaaatttccaaggtgtgccgaaggctatgcactatacgcccaggcattaacagatcaacaacagtttggtaaagctgatgaaatgtatgataaatgtattgatttggaaccagataatgctacaacatatgttcataaaggtttacttcaacttcagtggaagcaagatctggatagaggtttggaacttatcagcaaggctattgaaattgacaataaatgtgattttgcctatgaaaccatgggaactattgaagtacaaagaggaaacatggagaaagccattgacatgttcaacaaagctattaacctggccaaatcggaaatggagatggcccatctgtattcactttgcgatgccgcccatgcccagacagaagttgcaaagaaatacggattaaaaccaccaacattataaaacagggggaaagcagactgaccctctttttaaaagtttaccccctcttcaactgaaccctaaagacactgtcatgaactgtgttgaatggtggaaatcagtatttctgtttgtggtgttgttatttgttacatctgtttcatgtctaggtgttgtgggtgtggctgttg

SEQ ID NO: 6990 - DNA, 2785 bp, Homo sapiens
cgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggccccaccatggcgattcgcaagaaaagcaccaagagccccccagtgctgagccacgaattcgtcctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgttcttgaaaatacagtctgtgctctttgatttttgctattgtacggtttcatgcatttttttaaagggcatttgaggggaggattattgctatgaatgaaaaaaatattttagcttagactaagctacctgccttcaaaatagtttagggaccaccaccatattttattttgtttttatttttgaacatttttctaatgatttggagagaaaactatttacaaaaattccacatatcagtgatacaatttcttgctgtcaccaattttttataatagcagagtggcctgttctaagaaggccatattttttaagttatctttcagggtaacatggaaatactataaagttggatgtcaaactttaatatgttttcagtgttctctaattttttggaatttttgtagactttacacctggaaaaaaagatttgtaaaatcaccggaacaattgtgtgctttattttataggtagtggttattagtattacatccccattttaaaaacaaaaacataataatcgttacaacacgtggagttttactaacatacatattaaatcaaagtatattcttaaaagtacttgtgaagtaaaatctttcttgtgcattttcaatacttgtaaactggaaatcagaaaatatttactatgaacaggaaaatctgacatatagccctttttgatatgtttattaataatgattcttaatggggctcataataagtttaatatgcacagcatcttagaaaagtttaacctgcaaacacttttaaaacataatgcctacttgatttatatctataaaaagactgacaggtaattatatttggaaaacatttaatgcactaactttaaagaaattgaaaattcaggtggataaatagtcttacaaaagacaatgtgctttatgttatacctatagctttggtcccatctttaattgagaaacatttatctgtataaaacatatttttggataaatatatatatatatatttgtatctctacagaaaggctctaaaaagcatttgaggaaaatatttggttcccttttctataatcatcctttaagattcttatagctacatttggtttattcatcatatttacagtatatatattgttcttttcagtgttcacatcttgttccccatttctcacttgtgtcaccagctgtttgtgccatttttagtgtaaaagttgcagacctattagatctgcagtttaagttgccatgctgctaggaaattgtcctttttctttctagctgttaacctacttcctggaaaaagtagtagctctctgtagcattatggagtttcagtggaaccaaatttttgccattaaaaactggcattatactgaactatacattgagaaatcaatcaaaataaaaatttttactttcacaa

SEQ ID NO: 6991 - DNA, 1296 bp, Homo sapiens
cccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcagaatcacgcggacatcgtctcctgtgtggcgatggtcttcctgctggggctcatgtttgagataacggcaaaagcttctatcatttttgttactcttcagtacaatgtcaccctcccagcaacagaagaacaagctactgaatcagtgtccctttattactatggcatcaaagatttggctactgttttcttctacatgctagtggcgataattattcatgccgtaattcaagagtatatgttggataaaattaacaggcgaatgcacttctccaaaacaaaacacagcaagtttaatgaatctggtcagcttagtgcgttctacctttttgcctgtgtttggggcacattcattctcatctctgaaaactacatctcagacccaactatcttatggagggcttatccccataacctgatgacatttcaaatgaagtttttctacatatcacagctggcttactggcttcatgcttttcctgaactctacttccagaaaaccaaaaaagaagatattcctcgtcagcttgtctacattggtctttacctcttccacattgctggagcttaccttttgaacttgaatcatctaggacttgttcttctggtgctacattattttgttgaatttcttttccacatttcccgcctgttttattttagcaatgaaaagtatcagaaaggattttctctgtgggcagttctttttgttttgggaagacttctgactttaattctttcagtactgactgttggttttggccttgcaagagcagaaaatcagaagctggatttcagtactggaaacttcaatgtgttagctgttagaatcgctgttctggcatccatttgcgttactcaggcatttatgatgtggaagttcattaattttcagcttcgaaggtggagggaacattctgcttttcaggcaccagctgtgaagaagaaaccaacagtaactaaaggcagatcttctaaaaaaggaacagaaaatggtgtgaatggaacattaacttcaaatgtagcagactctccccggaataaaaaagagaaatcttcataatgaattataaactaattgattaatgtccccaaagaaatctgctttctactatatctttcagcattagagatttttctgtt

SEQ ID NO: 6992 - DNA, 2019 bp, Homo sapiens
gcgcatgctcagctcagctcggccctcgcctttgatttattttttttctgggcggccgctgcgacccgggactgacttcgggatgggaagtggagcccccggagctgctaccgtggcggcggcgctgtgaggagcagccagggggaggcagctgcggctcgccggtgagtatccgggaagcgccaccatggggctccgtaagaagagcaccaagaacccccccgttctcagccaggaattcatcctgcagaatcatgcggacatcgtctcctgcgtggggatgttcttcctgctggggcttgtgttcgagggaacagcagaagcatccatcgtgtttctcactcttcagcacagtgttgctgtccctgcagcagaggaacaagccacgggctcaaagtccctctattattatggtgtcaaagatttggccacggttttcttctacatgctggtggcaatcattattcatgccacaattcaggaatatgtgttggataaaattaacaagagaatgcagttcaccaaagcgaaacaaaacaagtttaacgagtctggtcagtttagtgtgttctactttttttcttgtatttggggcacattcattttaatctctgaaaactgcctgtcagacccaactcttatatggaaggctcgtccccatagcatgatgacatttcaaatgaagtttttctacatatcccagttggcttactggtttcatgcttttcctgaactctacttccagaaaaccaaaaaacaagacatccctcgtcaacttgtctacattggtcttcacctcttccacattactggagcttatctcttgtacttgaatcatttgggacttcttcttttggtactgcattattttgttgaattactttcccacatgtgcggcctgttttactttagtgatgaaaagtaccagaaaggcatatctctgtgggccattgtgtttatcttgggtagacttgtgactttaattgtttccgtactcactgttgggtttcacctggctggatcgcagaatcggaatcctgatgcccttactggaaatgtaaatgtgttggcagctaaaattgctgttctgtcgtccagttgcacgatccaagcctacgtaacatggaacttaattactctctggcttcagaggtgggtagaagattctaatattcaggcctcatgtatgaaaaagaaacggtcgagatcttctaaaaaaagaacagaaaacggagtgggagtggaaacttcaaatagagtagactgtccgccaaagaggaaagagaaatcttcataatctttgcaagcgcattgattaatgtctgcaaaggaatctgctctttgaggtttctttctgcactagagatttttctgtttttgaaaatagttcgtgctcttcggtttttgttattgaactgtttcatgtattttttaaagacatttgaggggaggaggattattatgaatgggaaaaaaagattttggttgagactaaattactcatcgtcaaaataatgtcaaaatagttttggggatcaccactatattttgttttgatttttaacctttcaacattttcctaatgatttgcagagataactgcacaattttgcatatcaatgatactggttcttactcccaccagtgtttcataatactaacaagatggtctctcctagcaagattatgtgtttaatgcttgctttggggtaaaataaaagtacgaaaaaggtggaagtcaaatcagtattctgtaattgttagaatttattttttaagaacttacaactcagaaaagattgctagactcaccaaaataataaatgttctttattttacaggtagtgattattagtgcttcatccccatttaaaaaaacacagtactaatgggtaacacatatggaggtttgctgccatatatattgcatcaaaatatcattaattaatataaaaatattaaaatcattcctgtccattccacttgtaaatgggaattcatgaaattaaatattacttt

SEQ ID NO: 6993 - DNA, 6908 bp, Homo sapiens
atggctttccgcaggaggacgaaaagttacccgctcttcagccaggagttcgtcatccacaaccatgcggacatcggcttctgcctggtgctctgcgtcctcatcgggcttatgttcgaggtcacagccaagactgcctttctatttattttacctcagtataacattagcgtgcctacagcagacagtgagaccgtgcactaccactatggccctaaggacctggtcacaatcttgttctacatcttcatcaccatcatcttgcatgctgtggttcaggagtacattttagataaaatcagcaaacggcttcatctctccaaagtcaaacacagcaagttcaatgaatctggacagctggtcgtctttcatttcacctcggtgatttggtgcttctacgtggtggtgacggaaggatacttaacaaacccaagaagcctctgggaagactacccgcatgtgcacctccccttccaggtgaagtttttctacctatgccagctggcctactggctgcacgcacttcctgagctatacttccagaaggtacggaaggaggaaattccccgccagctccagtatatttgcctgtacctggtgcatatagctggagcatacctcttaaacctgagccgcctgggcctgatcttgctgctgctgcagtactcaactgagttcctcttccacacggctagactcttctactttgcagatgaaaacaacgagaaactgttcagtgcctgggctgctgtttttggggttacccgcctcttcatcctcacccttgccgtgctggccattggctttggactggctcgcatggaaaaccaggcatttgatcccgagaaagggaacttcaacactttgttttgcaggctctgcgtgctgctgctggtgtgtgccgcccaggcctggctcatgtggcgcttcatccactcccagctgcggcactggcgggaatactggaatgagcagagtgcaaagcggagagtcccagccacacccagactaccagccaggctcatcaagagggaatctggttaccatgaaaatggagtggtgaaggcagagaacggaacctccccacggactaagaaactcaagtctccctaaggccaaagtgctaagaacaggaatcctcttggtgggggccgagcagggggcaaggagcccaggccccctccctgcctcctccttcctgcctgtgatgctccgtctcaaacagccgaaacctgtcttgcaatggggggagggggcgtttcgctttccttcttcttggcttcctcttattcttccacaaaccattctcaataaagccaaaaatctttctctttctccccctcaggccacctcctgtcctcactcctgtcctgtgctggcttttctggaacgccaggcgcccatggctggcacctttctgcttgctctgtctcttgccttatggctgctgcttttcctttttacttcctattttcaccttatcttgcaatttttctgtctgatttttacaatgggaggggagctaagattgcagtcctgtccttcggtcccccagggcctgccggtcagaagcctggggctggtaggcccttggtggtcctcatgtggatgggcaagaagagagcggccatctcggatcataatctccttggtgctgattaactgacgagatatatgattccagttctgcatgtaccatcttgaggcacagcagccactgctcgttgtaaatgccaaggcatttggctttgggacgtgacaactcaatccagaaggatggtgtgaactcggttgggtcccgtgactcgagctcctaccagtggctggccgcggattggaagccagcctgctgtcgctctgtggggggggacacgtcttcccactgcttagagcgagagcagagcaaactgcgcagcaggcacctccagaaaggtaatggtggcagaacccacagtggagtcgacctaggcctttctccagcagtcccagtcgccattgctttttcagccattcacaagcattcaaaaccaaaccaaacagcagttcatatacctgcctgagataggctggtcctcacctccagagccagccagccccgtcaggggccaaacttactaccttgacttcatctctagctgcagaaacactaagtctcaagggcttcagccccatgctggtcccttggtgttcagggagggtcacttggaccgctgttcatctggccgcccttgttgagtgttctttggaattgtcgttttttgagcacaactacagcattttagactgcatgaaaccatgactgactgagagtcactctctgggtagatgataggcgcctttctggccccttccctcacagattctttcccctcccctccacctgaagagaaggcctccaagtccttttggtgccttgtgaggacttttagaaggggcgttcagctttaaaaagccggtcctaattacggccggacgcagtagcttacgcctgttatcccagcactttgggaggtcgaggtgggcagatcacctgaggttaggagttcaagaccagcctggccaacatggtgaaaccccatctctactaaaaatacaaaaaattaggtgtagtggcaggcacctgtaatcccagctactcgggaggctgaggcaggagaatcgcttgaacctagaaggcggaggttgcagtgagcggagattgtaccatggcactccagcctggacaacaagagcgaaattctgtctaaaaaaacaaaagtcccaattaagaacctccgaactctgttttgaggcaaaggggagtagttcttggtaggtgcaggaatagtagtgtcatttggaatactggtcatctttctgacatcacagtagaaaccaaaccttggatttagattcaaaaggggggaaatgggtcttttcatcaaggcaactccccttctccaagtcacttacatcatagataaattttagcttcccagtaactgagggatttgtttcctaacgccattggaggccttcatccctctctacgataaggttgcagaaatgggaagagctacccgtggttgcttttgattacccttaggaagtgagacagtgtttttgaaaatatgtatttcccccatttctccctctccttccctgacacttctctgggctgcacagcagaaacgttggtaaaagggcagtttggtttcaacacagcagacctgatatgggatcccttagccactttagtcaaacagccctgacagagtctataattgagttcaggccccccaccttgcctaataactgcaaatcgcatgttcagccagcagcctcctaagcccaccttcctcccccattagagaacacccatcctaggtgctctccaggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaagctccccgtgctgccagtacttcatgccttggatgtggtcccaccagcccagtggccggggtcagcttaggctctgcttcccagtggacgggtgtgctaagggtttattttatgtaaaaaaaaaaaaaaaaacaaaaaaaaaccctgagaccatgagtggggctggcatcttgccagcctgggcttcagggatgtttggggggggtggttagagggtagttgtagggtactttgtcacccccctccccctgccaccctccctggcacgtttatttcacagcagagccaagtctgtggcaggttgacacagactgtgttgccagagctgaaataattccacttcatcctatgagcgtgttgggctagcttgttctaattttggccactttggctgttttcttcagttttatgcattctctcctgccccaaagtgccaagccatttgtgaaggctctgccagacacctccaagcttgagagctcagcaccatgcaccaagagcaggagaaaagacgtaaacctaccccagcaactgtggcctctcgacagccctggctaactaacttacatttgtggggaagccaacagacacagcaggaggagagggaggtggcgctggtggaccaaggatctgtgctacccgctcccctccttggaggtgcagtgatgatgggagttatttttaccatccgggcgctgatagctgcactattaataaattgcatgtgttccttttgaaggtaggggatggttctgggtgagaggggagcaggctgagccggcgggggatctgctgtcctcccttttgagtcagttctaatcccatgtgtgtctgggccaccagaccgaaatggttgctgagaaacttgtctgttcatgtcccaaggcataacttcccaacatttaagaaaccccaatagacacctctgccctggccacgttcacagatccttctcttgaccggaaaccctgggaccctaagaacccctgaagcttggggtgggtgtgtgcttctggggtctcttttgggacctcctttgtcagtaccccttcttttttctaagcagctaataagaggttgggtgaaagagtgcatctcctcccaggattccacaacaaaattcttatcttccatggatgctttaattggaagtgggttgccgacccccttgtgcctagaaaaggccttcgcttgggtttcctttgtatgcttcagccttcctagttggtttttctaggcctggtgtgagaggtagggaagtctgcacataactaattcttttgcttaagggcctatggcacaagtgcacaaacttcaattcttgatgttctaagctctctcctctaacagagggagtgctgaaagcttttgagtcaagacaatggagtgctcttcctccctcactctgccttccgagcttatggttccttttctcaggagaggattttcaggattattggaggattaggtcattgtcagatgactggaaaacctaaataggatctctctccagctcaaggttgtcccagtgaggaagactttaccaacttctcactctaccccactactcacatgagtgttagctccaccttgcaaaggctgaagaccagttctccccagtgaaagctgcctcattcttttatggagttccctggagtggcagagctataaagacgagcattgggatttgcagtctccatgtagcctttcgtgcttggcaacccctgtagactttttgtcccaagcagattgcgtgcgtgcgcctgtgtgtgagaataagtgccttactttgctgtgtggttttcaacttgtactccgtggccagcccccagttgccagggctcgacggcagccaaggacaccatacctcagtatagttatatataaaagggacacggattgtgacagtttcaccccatttgtttctaaccccgctgcccaggattagggtctgtggtgtgttctgttttgtttttggtttctcccttgtgtcagttctcttctggcccagctgggtggctgtggaagtctgtgaggtggcccaaccacaagcatacctattaagagaagcccagagcttccagcccccacttcgaaaactctcctctggccccacatagcaaactccttctccgttattttccccacccccagattttttttaaaaggcccacttgccgtaacctcttttggtctattttgcttcccattcagcccaaagtttatatgataaaggtgtttacttttacttcccagtctccaagtgctaacacataaacacatacatgtctgactgttgcagaactgttcgagctcctaattcagtgttaccttgttttagtcgcagcaaccctctcccctaccccttgcccgcccacgtttttctcactcttccgggttgtgcaataactctcccagccagtggtcctttccacagcctttctgtcccttaaaacacctgcaactgggggagaaatgggacccatgggagggggagtcgtcatcccttacacaagaaatagccactttccttttgttgtcattcttgtgatcctgggtgggtttctgtggcactcttttagaacatgtagcatcatcttagaggtctatttttaaaaaatgtgttgaagaggaaaaaaccattctcacgatggggcttaagtcattgtccaggaataagattggcgtggtgcccatgacatcaccgtcactctgcctaaaagcactctagagctacttgttcacgtggagaggaaggatattttgcgaagcaacagccgcaggtggagagccctgttcacctgatagggtctagctgtgacagtaaatataataccgctgtttccttgggtacagatttgagtgttcatgtgatgagactgtaaacctcatttttcggttcctctgtttaaaaaaacatctgaaggatgaactaaggctgctggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggattttttaaatgtacattttggaacaaatgatcaaatattttctgaaataacaataaaaggcagaaaattatcagaa

SEQ ID NO: 6994 - DNA, 958 bp, Homo sapiens
atcagcttaggtagaacagttctcggtgagggccagctacatacctggctaagcgctgcccactgcagaaaagctcatcacccgggacctgatctccaggactcagaagcacttggaggaaggcctattcacttagaagcagttaccagtgctgggcagtgtcctccaagtgccagaggagtgctgtggagaaaagaagtccatggaagccaggagatgggcaagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtgggctatgcctcctacctggtgtggaaggacctgggagggggcttggggtggcccctggccctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttagggttcaccccaatgggaccaccctcctgggtcccctggtgccgtttttccttagaaatcagagaaatgggaaagggggggaaactgattttacacttaaataataaaatcctattagtaactctgaa

SEQ ID NO: 6995 - DNA, 699 bp, Homo sapiens
tccaagtgccagaggagtgctgtggagaaaagaagtccatggaagccaggagatgggcaaggtgtggcctggggttggagagagctcagagattttgcctcttcaaggtgaatgcggcttcaaggggctatctttgtgctcctgccccacctggggcccatcctggtctggctgttcactcgtgatcacatgtctggttggtgtgagggcccgaggatgctgtcctggtgcccattctacaaagtcttattgcttgtacagacagccatctactctgtcgtgggctatgcctcctacctggtgtggaaggacctgggagggggcttggggtggcccctggccctgcctcttggcctctatgctgttcagctcaccatcagctggactgtcctggttctctttttcacagtccacaaccctggtctggccctgctgcacctgctgctgctgtatgggctggtggtgagcacagcactgatctggcatcccatcaacaaactggctgccctgttactgctgccctacctagcctggctcaccgtgacttcagccctcacctaccacctgtggagggacagcctttgtccagtgcaccagcctcagcccacggagaagagtgactgaggccctagggcatgggagaggagggacgcccagggtggggaggaagagtctgcaagcagggctgtggagttaggg

SEQ ID NO: 6996 - DNA, 1450 bp, Homo sapiens
acctgccgccatcttgctcaccagcctccaaaatgcggctggggctcctgagcgtggcgctgttgtttgtggggagctctcacttatactcagaccactactcgccctctggaaggcacaggctcggcccctcgccggaaccggcggctagttcccagcaggctgaggccgtccgcaagaggctccggcggcggagggagggaggggcgcatgcagaggattgtggaacagcaccgcttaaggatgtgttgcaagggtctcggattatagggggcaccgaagcacaagctggcgcatggccgtgggtggtgagcctgcagattaaatatggccgtgttcttgttcatgtatgtgggggaaccctagtgagagagaggtgggtcctcacagctgcccactgcactaaagacgctagcgatcctttaatgtggacagctgtgattggaactaataatatacatggacgctatcctcataccaagaagataaaaattaaagcaatcattattcatccaaacttcattttggaatcttatgtaaatgatattgcactttttcacttaaaaaaagcagtgaggtataatgactatattcagcctatttgcctaccttttgatgttttccaaatcctggacggaaacacaaagtgttttataagtggctggggaagaacaaaagaagaaggtaacgctacaaatattttacaagatgcagaagtgcattatatttctcgagagatgtgtaattctgagaggagttatgggggaataattcctaacacttcattttgtgcaggtgatgaagatggagcttttgatacttgcaggggtgacagtgggggaccattaatgtgctacttaccagaatataaaagattttttgtaatgggaattaccagttacggacatggctgtggtcgaagaggttttcctggtgtctatattgggccatccttctaccaaaagtggctgacagagcatttcttccatgcaagcactcaaggcatacttactataaatattttacgtggccagatcctcatagctttatgttttgtcatcttactagcaacaacataaagaaattctgaaggctttcatatctttattttgcattgtgtccctttctatgttctatataatgaacatcatttattcttctagcaattaattgcctacattagagatttcatgtgaacattttatgggctataagtattgtgacagatatacaattgtaattttggcactgaatcacatgtctccttgaaatatcttgattattttataatcataattctgtatctggaatactcatagagtttgtacaaaatattcagttaaacatatattttatgtgtataaatgccaaataatagtttataattaaaatgaaagctgtcatttggttaaattaataaaaattctttcttagattttattctaaaaaa

SEQ ID NO: 6997 - DNA, 3852 bp, Homo sapiens
aacacaaggtcagggttaagccttcggtgctttaatccagaggaaaattacttattttaaaaagcagtgaaaaacaccgcattcctttggcacaggatgaagaccagctcagctcttcagttgttgatcattgtctattgttctccaaacagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaacttcagaaatacttctgccctttgatcaaacaaatccatttccaagaatctgtactagggaagtaaataagaatatgagagaaacctttatgcaaatatgtatattgcaacattatttaatattctggaaaattggaaacaccccaaaattctaaactcagaggaaggattaagtaaagagtggtacatactgtaaatgttttctgatattaaaaaaaaaattaaataaaaaataaagagtactacatggttgtaaaattacagtcattacaaatgatgtttttaaaattatgaataatgctacatcaaaaagcaggttacaaattcatgtttactatataactatttaaagcaaatgaaacactaatagtcaaagtttaggatgaaaactaaatctaaaaggaaatataacaaaatgccaattatgcttggtttggggcattgatgacccttcttcccacttttctatattttccaagatttctttattgaatatgttttactataaatattttctaaactcatattttcactattaaaatttttttatttttccaaactttaaggcatatgctctttccacattcctcaacattatttgcaaacatcatgaaatgacacttccatcaacattcaatgaggaaagtagtgatatagatgagccaaaaagagttttatataaacttatacaatctaaactcttgctcttcctttctgactcctgagggtgagtgtgatggactagaagaggtagccttaaaataagtgagcagctagggaacatgctcaatgggcaagagaaaatgaccactgaccagtcaatacctgtgtcagggggagttaccagtacctatatttatttttaaagtaattaaaaagtagaacacttacaaattttccacctatacatgccatgtcttcctcggggacagtagccacatcttatatatttcccaccatgcataggacccagcacacagtgaagccagtaggcactcagtgttgaatgctcataccaggttttctgcttcctgtagttaccctgctgagcactgcttccatcacaggtgcactgggcctcaacacttctgccatttccccatttgtctcctccatggacactgtcaacaatggtctgtcaacacctgctctgtgccaaagccagggagtaggctggggggatacggaagagaatatctttctccttgatgcctgctgtgccaacagccccctttaagccttgttcacagcctttgctgaaacaagcatcttgaaagcaagccatgttatacaccgcatgaccttcatgctctgggcccagctgactgaactggggcaggccccagagtcatgggcagcctattgtcttgctaatggcctctgacttagcctggagtaaaacactgtccaaacaagactggtggttattcaagcataagaatttgaactaggaagccaagaatgaagcaaccggaccattaccatcaaaaaatgattaaaggatgaagaaggaagccaacattcagagagtatctggttcatgttaataatggtatcatattaaaaggaagatacatgaacttctactccaaaagctcctaaaactgcctttgcccacaatgaacagtgtaccctaggcctggtttctgttcttggattcctagatagtctttcttctttgtcactgtgctgatcatttcagtaaacccccgactaaatcagtgcagctctgtttattgcaactaaaacgatccaaatgaagtctcccttttctagatgttgggttggagggatgctaagacaaagatgcttaggctccagagttttacagagcttcattcaataacactctactttccaaagaacttaaatatgaggtctgaaggacttggaccaagaggcaaacccaagctacagacaccatgttgtactcagagtgacctctcccctctgacagcccaggatttctctatcaagtccataagctagtcatatctaggaccatcttgttaaaaattctctcaaagtctcctcagccctcttgtaaacagacttctggaaggtccacttcatcagtttgttatatactttcagactgtctatctcttgtttagattcagcatggcaccgtacgttgaatggactgttaatagatgtttgctgaatgactccaccacagcattggacacatcaggggtacagccaaatgcagcatgatacctctatcaggaaaattaaattttaacacagccaccaaatattctatatttgaagagtatatgctaatcatgcaattttaagtaaaaaaaagctgaatacaaaaaaagctgaatatgtgttttatatcctcgtgaattcaaagtaaaaaggaaaaaaaactcaaaaaccaaatatatgtatgcagtttgagcccaaatttttaattaagtaaccatataattacatgtagacatgtataaaccttgagatatgtaaagaccagaaaaatatttaaaagttaatagttacatcatctgtggtcacaacaccctgaaaatgcctaatattggaaacttaagcaggattgatccaggttattacttggatgggagaccagatgctataggctgaaaaaagaaagcataagtacgcacaagttaatacttaataattatctcctaatgataggactataagttctatctcttttctttacattgttcagtattttcaaatttccctttgaaaatgtgttatgtacttgaattattagaaaaaataaatgtcatttaaaaagcaa

SEQ ID NO: 6998 - DNA, 907 bp, Homo sapiens
gagagagagagagaaaaaaaaggtcaggtaggaagaagaaaaatagactttctgtgactgtatactcttgaaatctcccgcaggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcattttattttccattctcataaccctcagtgggcttcaagtgatcatctgcctcatcagagtagtcatgcaactatccaagatactgtgtggaagctattcagtgatcttccagcctggaatcatttgaataaggacaaaatgttttccattatcaagacatggccatctatctaaatattatatcaactgtgtagacttgagggcaatattgaaatgatggtgctttctgcatttggtgtttatttgtaaaaaatttgcagtcctcactgcacatgcaagtataccacccttccatttagtatgttttttaagtaatatgcatcagaaa

SEQ ID NO: 6999 - DNA, 662 bp, Homo sapiens
gtcttactttgtcacccaggctggagtgcagtggaacgatctcggctcactgcaacctccgtctcccagtaaaccagtatttcacactgagattgtcggctgcgggtatattccaattccccgtctcctcatgaatatgaagtgaagggctctgaccctggaagtggttctaagcagggcaaaatggggtctcggaagtgtggaggctgcctaagttgtttgctgattccgcttgcactttggagtataatcgtgaacatattattgtatttcccgaatgggcaaacttcctatgcatccagcaataaactcaccaactacgtgtggtattttgaaggaatctgtttctcaggcatcatgatgcttatagtaacaacagttcttctggtactggagaataataacaactataaatgttgccagagtgaaaactgcagcaaaaaatatgtgacactgctgtcaattatcttttcttccctcggaattgctttttctggatactgcctggtcatctctgccttgggtcttgtccaagggccatattgccgcacccttgatggctgggagtatgcttttgaaggcactgctggacgtttccttacagattctagcatatggattcagtgcctggaacctgcacatgttgtggagtggaacatcat

SEQ ID NO: 7000 - DNA, 1022 bp, Homo sapiens
aaagagtcctggaaagacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagc

SEQ ID NO: 7001 - DNA, 964 bp, Homo sapiens
gacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtactcactgcagctatcctcatctccttgatgggctggagatacggctgcttcagtaagagtgggctctgtcgaagcgtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggttcaggccctctgtggttaaagactgtatccatgctgtgctcaaggaggaactggcaaatgctgaatattctccagaagaaatgcctcagcttacaaaacatttatcagaaaacattaaagataaattaaaaggtaatcatggtgataa

SEQ ID NO: 7002 - DNA, 1061 bp, Homo sapiens
ctccggggagcggaagcgccttcaatgcaggcctgtgggcaggggcgtgggggcgcgcacacacacacgcctgggtgacctctacgtatatacagagcctccctggccctcctggaaagagtcctggaaagacaaccttcaggtccagccctggagctggaggagtggagccccactctgaagacgcagcctttctccaggttctgtctctcccattctgattcttgacaccagatgcaggatggtgtcctctccctgcacgcaggcaagctcacggacttgctcccgtatcctgggactgagccttgggactgcagccctgtttgctgctggggccaacgtggcactcctccttcctaactgggatgtcacctacctgttgaggggcctccttggcaggcatgccatgctgggaactgggctctggggaggaggcctcatggtgcttactgctctgttgtcaggtggcctggctttacttggagccctgatttgctttgtcacttctggagttgctctgaaagatggtcctttttgcatgtttgatgtttcatccttcaatcagacacaagcttggaaatatggttacccattcaaagacctgcatagtaggaattatctgtatgaccgttcgctctggaactccgtctgcctggagccctctgcagctgttgtctggcacgtgtccctcttctccgcccttctgtgcatcagcctgctccagcttctcctggtggtcgttcatgtcatcaacagcctcctgggccttttctgcagcctctgcgagaagtgacaggcagaaccttcacttgcaagcatgggtgttttcatcatcggctgtcttgaatcctttctacaaggagtgggtacgaattataaacaaacttcccctttaggtatccctggagtaataatgacaacaaaattcactgcaggtcggtggaatgatagaatgcattttaaatcacattgtaaacttccaggtgatccatggataggataaataactaagttattataattgtttaggaatttatagtccataaaatatcctccagcca

SEQ ID NO: 7003 - DNA, 2296 bp, Homo sapiens
atagccactttgacaacgtttctgagccaggggtgaccatgacctgctgcgaaggatggacatcctgcaatggattcagcctgctggttctactgctgttaggagtagttctcaatgcgatacctctaattgtcagcttagttgaggaagaccaattttctcaaaaccccatctcttgctttgagtggtggttcccaggaattataggagcaggtctgatggccattccagcaacaacaatgtccttgacagcaagaaaaagagcgtgctgcaacaacagaactggaatgtttctttcatcacttttcagtgtgatcacagtcattggtgctctgtattgcatgctgatatccatccaggctctcttaaaaggtcctctcatgtgtaattctccaagcaacagtaatgccaattgtgaattttcattgaaaaacatcagtgacattcatccagaatccttcaacttgcagtggtttttcaatgactcttgtgcacctcctactggtttcaataaacccaccagtaacgacaccatggcgagtggctggagagcatctagtttccacttcgattctgaagaaaacaaacataggcttatccacttctcagtatttttaggtctattgcttgttggaattctggaggtcctgtttgggctcagtcagatagtcatcggtttccttggctgtctgtgtggagtctctaagcgaagaagtcaaattgtgtagtttaatgggaataaaatgtaagtatcagtagtttgaattaatttgagaagtacacttgttttcaaagtcatctttgagatgatttaaaaaatcaacccttcacgtagaaagcacgttgtaaatgcataacactctcatatcagtggttgatttgggaaaggtggagagaattttcaattagttttgtgttgtactattcaaattttttacctcttcactgtgtgtagagaaaggagaagggaaggaggatgagaaggaacggaagtcatcctgaaaataaaagtacaggactttttttttttttttttgagacagggtctcaaaaaaggctggagtacagtagtacagtggtgctatctcagcttactgcagcctcaacctcctgggctcaggtgattctcccatctcagcctccctagtagctgggactacaggtgcgtgccactatgccaagctaatttttgtatttttagtagagatgggggttttccatattgcccaggctggtcccgaactcatggactcaagtgatctgcctgcctcagcctcctaaagtgctgcgattacaggcatgagccatcgcgcctaaaggacaggacctttttattgtatttctttaaagaataaatacataacctgaatgcaatcaagtctttagatctaattctcagcttgcagggaacactaggacaaatccaaaaagtgggtcagcgggcacagaatggcccaattttcaacaggaaaatgttataaaagaaaaatatttttgagggaactgttatagattaagagaatagaggcatgtttcagctaaacacatgtaaactttgtcagagataattgggaggagtatgtagaagaatcggattattgttaattttggtaggtctgataatggttttatagtataaaggctgagtaccccttatccaaaatgattaagatcagaagtgttttggctttcacatttttttggattttggaattttgcctataataatgagacatcttggggatgggatgcaagtctaaccacaaaattcatttatgtctcatacacactttgaacacctggcctgaaggtaatttcacacaatattttaaataactttgtgcatgaaacacaattttgactgcattttgactgcaactcatcacatgaggtcaggtatggaattttccacttgtggtgttacgttactggctcaaaaagttttggatctcggagcattctggattttgaatttttggattagtgatgctcaacctgtatacagaaatgtcctcatttttaaaaaaagaaatgcatatttatatgttttaaaattacttcaaccaaaagcaacggggagatgtttactgttatatttaggtgacaggtacatggcaattcattataccctcctattttcctatgtttacattattcattaattaaaaaacaatacctagaaaaacccaagactttcaaaagctattttctatatgtgccaatctttaaaaaacaggataacaagggtatttatcacattaaaatgttgtaaaacagcaaagctaaaaatctaaaa

SEQ ID NO: 7004 - DNA, 542 bp, Homo sapiens
aaacaggcacgtgtgttgggcagatactaaaaagtggtcatcattctcctcttcagttataagctaattctcttttcagctttatactgaaatatcttccccttcatcacatacagattaaatttctacatttttacagaattcttcagatacttccttttagccacaaatgtaaggagtactaaacccgagtggaactatgttatgcccactagcaaaagcatgcagcttactcagttttggtcaaatggcaaagactctggaaatcagacacttgattctcacagtcaggtggagtccaaccgatccagttccctacatataaaatgattccctaaacagttcttcaattcaacatcttatgaagacagcaaaaagatttgaaatggcacaacccacattctaagcgttaaattttaaccagaagattgggataaaaggcaacatagtaccatgcaagcatagccactttgacaacgtttctgagccaggggtgaccatgacctgctgcgaaggatggacatcctgcaatggattcagcc

SEQ ID NO: 7005 - DNA, 2452 bp, Homo sapiens
gacgtgtcctgggccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttattaagaaaaaggctca

SEQ ID NO: 7006 - DNA, 2055 bp, Homo sapiens
cgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcaggtatcctccctttattccatggctattactgtcaggttcctgacctcaatttttcctgtccctactcatccagtaccctaacccaacccgttgatccctggttcagtggtaccattcagagatcattaaatggttcctcctatccccaagcaggactgagcttgaatgatatgagagtgtctcacttataaagctctccggagacatttcccccttcaccttcctggtttctgactttaatgcctatggacatcatgtggggtttaaagcccatttgatgacccatttactttgttgaatacctctttgtgccaggcaaagaataaagtggaataaaa

SEQ ID NO: 7007 - DNA, 882 bp, Homo sapiens
gacgtgtcctgggccgcgctgccgatcgccgggaggacccccgcctcgccgaagacgggcggggcaagccgagcctcacggggtccccggagctgggccgggcctccagatggagaaggcgcaacggggagttcttgagttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactcca

SEQ ID NO: 7008 - DNA, 904 bp, Homo sapiens
ggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggattcccccaaacaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgag

SEQ ID NO: 7009 - DNA, 961 bp, Homo sapiens
gcgcggtgaggaccccggggctgtggcgggaagggacccgaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccc

SEQ ID NO: 7010 - DNA, 1065 bp, Homo sapiens
ctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagagaccccagcaggagcccaaaggcagctacgggggcgcgaaggccgctggcgccgcctcggccagcccttcccgcgcggtgaggaccccggggctgtggcgggaagggacccgaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaa

SEQ ID NO: 7011 - DNA, 2740 bp, Homo sapiens
gctgaggggcggaggcgggagaggcgagctcgcgatgagtggtctcggcaggctcttcgggaaggggaagaaggagaaagggccaacccctgaagaagcaatacagaaactgaaggagacagagaagatactgatcaagaaacaggaatttttggagcagaagattcaacaggagctacaaacagccaagaagtatgggaccaagaataagagagctgccctacaggctttgcggaggaagaaaagattcgaacagcagctggcacaaactgacgggacattatccaccctggagtttcagcgtgaggccattgagaatgccactaccaatgcagaagtccttcgtaccatggagcttgctgcccaaagcatgaagaaggcctaccaggacatggacattgacaaggtagatgaactgatgactgacatcacggaacaacaggaggtggcccagcagatctcagatgccatttctcggcctatgggctttggagatgatgtggatgaggatgaactgctggaggagctagaggagctggagcaggaggaattggcccaggagttgttaaatgtgggcgacaaggaagaagaaccctcagtcaaattgcctagtgtaccttctactcatctgccggcagggccaggttccactgccttaaggatgacagtcgtagggaaccctcgaagttggagctgccagtggttgccaatcctgatactgttgctgggcacaggccatgggccaggggtggaaggcgtgacacactacaaggccggcgaccctgttattctgtatgtcaacaaagtgggaccctaccataaccctcaggaaacttaccactactatcagcttccagtctgctgccctgagaagatacgtcacaaaagccttagcctgggtgaagtgctggatggggaccgaatggctgagtctttgtatgagatccgctttcgggaaaacgtggagaagagaattctgtgccacatgcagctcagttctgcacaggtggagcagctgcgccaggccattgaagaactgtactactttgaatttgtggtagatgacttgccaatccggggctttgtgggctacatggaggagagtggtttcctgccacacagccacaagataggactctggacccatttggacttccacctagaattccatggagaccgaattatatttgccaatgtttcagtgcgggacgtcaagccccacagcttggatgggttacgacctgacgagttcctaggccttacccacacttatagcgtgcgctggtctgagacttcagtggagcgtcggagtgacaggcgccgtggtgacgatggtggtttctttcctcgaacactggaaatccattggttgtccatcatcaactccatggtgcttgtgtttttactggtgggttttgtggctgtcattctaatgcgtgtgcttcggaatgacctggctcggtacaacttagatgaggagaccacctctgcaggttctggtgatgactttgaccagggtgacaatggctggaaaattatccatacagatgtcttccgcttccccccataccgtggtctgctctgtgctgtgcttggcgtgggtgcccagttcctggcccttggcactggcattattgtcatggcactgctgggcatgttcaatgtgcaccgtcatggggccattaactcagcagccatcttgttgtatgccctgacctgctgcatctctggctacgtgtccagccacttctaccggcagattggaggcgagcgttgggtgtggaacatcattctcaccaccagtctcttctctgtgcctttcttcctgacgtggagtgtggtgaactcagtgcattgggccaatggttcgacacaggctctgccagccacaaccatcctgctgcttctgacggtttggctgctggtgggctttcccctcactgtcattggaggcatctttgggaagaacaacgccagcccctttgatgcaccctgtcgcaccaagaacatcgcccgggagattccaccccagccctggtacaagtctactgtcatccacatgactgttggaggcttcctgcctttcagtgccatctctgtggagctgtactacatctttgccacagtatggggtcgggagcagtacactttgtacggcatcctcttctttgtcttcgccatcctgctgagtgtgggggcttgcatctccattgcactcacctacttccagttgtctggggaggattaccgctggtggtggcgatctgtgctgagtgttggctccaccggcctcttcatcttcctctactcagttttctattatgcccggcgctccaacatgtctggggcagtacagacagtagagttcttcggctactccttactcactggttatgtcttcttcctcatgctgggcaccatctcctttttttcttccctaaagttcatccggtatatctatgttaacctcaagatggactgagttctgtatggcagaactattgctgttctctccctttcttcatgccctgttgaactctcctaccagcttctcttctgattgactgaattgtgtgatggcattgttgccttcccttttgccctttgggcattccttccccagagagggcctggaaattataaatctctatcacataaggattatatatttgaactttttaagttgcctttagttttggtcctgatttttctttttacaattaccaaaataaaatttatt

SEQ ID NO: 7012 - DNA, 2740 bp, Homo sapiens; identical to SEQ ID NO: 7011

SEQ ID NO: 7013 - DNA, 2815 bp, Homo sapiens
gcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtc

SEQ ID NO: 7014 - DNA, 6141 bp, Homo sapiens
gaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatctattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgtac

SEQ ID NO: 7015 - DNA, 868 bp, Homo sapiens
cgtgattcattcacagcggcagacgagcgccaggaaagggttatttgatctgatccctcaagttccggaggcagcagtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctgg

SEQ ID NO: 7016 - DNA, 4032 bp, Homo sapiens
ccaagatggcgacggcgatggtgagtgaaggagactccgggagcgggagctggagcggggccctccggggtatcccaggatcttccagcaccccatgcctggccctgagccacctccgggacccctgactcaggcctgagggctacctctgactgggcttgtcttccccgaaatccacctccctggccctgcccctgcactcaggcttgtgaaggccccgagttttgggggaggcgccgtttcggaggaagacctcggctgctgccttcgccggttcccattctacttttggtctccgcccactgattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctactg

SEQ ID NO: 7017 - DNA, 3978 bp, Homo sapiens
agtttctgccaggagctaatatggcttccttagttacaccgttctctctcttcacctaatcagcgaccttactttcccagaccagactgtcgagcaggagctaagactccttttcccctctgctgaccgccactacaggagcggttgaagccagacgaccaccttgtggagttaaactccgtaaccagggagcaccacttccgctgacgtcattacggcgacacgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggagaggtgctgagaggggaccggattgtcaacacccctttccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacattgaagacaccatggaggagtctgggtggaagttggtgcacggcgacgtcttcaggcccccccagtaccccatgatcctcagctccctgctgggctcaggcattcagctgttctgtatgatcctcatcgtcatctttgtagccatgcttgggatgctgtcgccctccagccggggagctctcatgaccacagcctgcttcctcttcatgttcatgggggtgtttggcggattttctgctggccgtctgtaccgcactttaaaaggccatcggtggaagaaaggagccttctgtacggcaactctgtaccctggtgtggtttttggcatctgcttcgtattgaattgcttcatttggggaaagcactcatcaggagcggtgccctttcccaccatggtggctctgctgtgcatgtggttcgggatctccctgcccctcgtctacttgggctactacttcggcttccgaaagcagccatatgacaaccctgtgcgcaccaaccagattccccggcagatccccgagcagcggtggtacatgaaccgatttgtgggcatcctcatggctgggatcttgcccttcggcgccatgttcatcgagctcttcttcatcttcagtgctatctgggagaatcagttctattacctctttggcttcctgttccttgttttcatcatcctggtggtatcctgttcacaaatcagcatcgtcatggtgtacttccagctgtgtgcagaggattaccgctggtggtggagaaatttcctagtctccgggggctctgcattctacgtcctggtttatgccatcttttatttcgttaacaagctggacatcgtggagttcatcccctctctcctctactttggctacacggccctcatggtcttgtccttctggctgctaacgggtaccatcggcttctatgcagcctacatgtttgttcgcaagatctatgctgctgtgaagatagactgattggagtggaccacggccaagcttgctccgtcctcggacaggaagccaccctgcgtgggggactgcaggcacgcaaaataaaataactcctgctcgtttggaatgtaactcctggcacagtgttcctggatcctggggctgcgtggggggcgggagggcctgtagataatcttgcgtttttcgtcatcttattccagttctgtgggggatgagtttttttgtgggttgctttttcttcagtgctaagaaagttccctccaacaggaactctctgacctgtttattcaggtgtatttctggtttggatttttttttccttctttgttttaacaaatggatccaggatggataaatccaccgagataagggttttggtcactgtctccacctcagttcctcagggctgttggccaccctatgactaactggaagaggacacgccagagcttcagtgaggtttccgagcctctccctgcccatcctcaccactgaggccacgacaaagcacagctccagctcggacagcaccctcagtgccagccagcctctgccagacctctctttccctcttctccccagcctcctccagggctgcccaaggcagggtttccagccaggcctcggggtcatcttttcaccaggagcaaacccaagtcttagttgctacaagaaaatcccctggaagtactgggggccaggttccccagacagcaggaattgcccctgttcagagcagccggagtttgctggaccacaaggaagaagagaagagacttgcagtgaactgtttttgtgccaagaaaccctggacctggggccaagtatttcccaagccaagcatccacttgtctgtgtctgggaagggatggccaaggccgctagggtccttacccctcaggatcactccccagccctttcctcaggaggtaccgctctccaaggtgtgctagcagtgggccctgcccaacttcaggcagaacagggaggcccagagattacagatcccctcctgtaagtggccaggcattctctccctgccctctctggcctctggggtcatactcacttctttagccagccccatcccctccaccccacacctgagttcttgcctcctccttttggggacacccaaaacactgcttgtgagaaggaagatggaaggtaagttctgtcgttctttccccaatccccaggaatggacaagaagccaacttagaaagaagggtctcacgtggctggcctggctcctccgtagacccctgttcttttcaacctctgcccacccgtgcatgtcatcacaaacatttgctcttaagttacaagagaccacatccacccagggattagggttcaagtagcagctgctaacccttgcaccagcccttgtgggactcccaacacaagacaaagctcaggatgctggtgatgctaggaagatgtccctcccctcactgccccacattctcccagtggctctaccagcctcacccatcaaaccagtgaatttctcaatcttgcctcacagtgactgcagcgccaagcggcatccaccaagcatcaagttggagaaaagggaacccaagcagtagagagcgatattggagtcttttgttcattcaaatcttggatttttttttttccctaagagattctctttttagggggaatgggaaacggacacctcataaagggttcaaagatcatcaatttttctgactttttaaatcattatcattattatttttaattaaaaaaatgcctgtatgcctttttttggtcggattgtaaataaatataccattgtcctactg

SEQ ID NO: 7018 - DNA, 1044 bp, Homo sapiens
acgtggatccaagatggcgacggcgatggattggttgccgtggtctttactgcttttctccctgatgtgtgaaacaagcgccttctatgtgcctggggtcgcgcctatcaacttccaccagaacgatcccgtagaaatcaaggctgtgaagctcaccagctctcgaacccagctaccttatgaatactattcactgcccttctgccagcccagcaagataacctacaaggcagagaatctgggaaggagaaaggagagaactggttcttgagcaagcccctgaaagggctgccttctccgtcagggctacgcatggctcagatgtttctggaacctctagctgacaaatttatctactgccaggttctcatgaacagcgagaagaagtgtgaagttctgtgcagccagtccaacaagccagtgaccctgacagtggagcagagccgactcgtggccgagcggatcacagaagactactacgtccacctcattgctgacaacctgcctgtggccacccggctggagctctactccaaccgagacagcgatgacaagaagaaggaaaaagatgtgcagtttgaacacggctaccggctcggcttcacagatgtcaacaagatctacctgcacaaccacctctcattcatcctttactatcatcgggaggacatggaagaggaccaggagcacacgtaccgtgtcgtccgcttcgaggtgattccccagagcatcaggctggaggacctcaaagcagatgagaagagttcgtgcactctgcctgagggtaccaactcctcgccccaagaaattgaccccaccaaggagaatcagctgtacttcacctactctgtccactgggaggaaagtgatatcaaatgggcctctcgctgggacacttacctgaccatgagtgacgtccagatccactggttttctatcattaactccgttgttgtggtcttcttcctgtcaggtatcctgagcatgattatcattcggaccctccggaaggacattgccaactacaacaaggaggatgacatt

SEQ ID NO: 7019 - DNA, 1785 bp, Homo sapiens
gttatttaaaaaacccttcgtggattgctttgtctgaagatcctctgggtgatcatggttcagcgctttagcctcaggaggcagctatccaagatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatct

SEQ ID NO: 7020 - DNA, 5992 bp, Homo sapiens
gacacagtgtccatcctcccagattggatctctttttcatatggatcttctgtttctatgtctttttaaaaaataactttttgggaaaccttttggattacaactgttcatcctcacctatgcaaagaaagggaagctattgctgggattttgaggagcttttcctaaaaggattgtacaccttagaagtgcttaaggaagagtgatgaagataggcatgaagccttcgtctcacagctgcatgcgtagtcactgttgaagcaaatgcctacctaatttgacactcttggtgtgtttaaaaaatttttttgagtttgcaaataagcatattaagtctactgatggagccttcgggcagtgaacagttatttgaggaccctgatcctggaggcaaatcccaagatgcagaggccagaaagcagacagaatcagaacaaaaattgtctaaaatgacccacaatgctttggagaacattaacgtgattggccaaggcttgaagcatctcttccagcaccagcgcaggaggtcatcagtgtctccacatgatgtgcagcaaattcaggcagatccagaacctgaaatggatctggaaagccagaacgcatgtgctgagattgatggtgtccccacccaccccacagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccagctctgctatgatggaaatagcttgtgctgctgctgctgctgctgctgcatgtctaccaggagaggagggaactgcggagcggatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccccgtcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcaactaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaa

SEQ ID NO: 7021 - DNA, 5484 bp, Homo sapiens
ggcggccgcagtggaaggagcaggcgcttgagctcgagcgacggcgctggcggagacgccggctgctcctcccctccccgccgcttttcctaaaaggattgtacaccttagaagtgcttaaggaagagtgatgaagctctgaatcgtgtcctgcagcagattcgagtgccacccaagatgaagagagggacaagcttgcatagtaggcggggcaagccagaggccccaaagggaagtccccaaatcaacaggaagtctggtcaggagatgacagctgttatgcagtcaggccgacccaggtcttcatccacaactgatgcacctaccagctctgctatgatggaaatagcttgtgctgctgctgctgctgctgctgcatgtctaccaggagaggagggaactgcggagcggatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccccgtcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcaactaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctatt

SEQ ID NO: 7022 - DNA, 5631 bp, Homo sapiens
tttgcattagctgctctagcaaactgcgtgcgcgcgcacacacacggatgcttgtttggcagaagctttctgtttattcagcacagagttctcctaggctcccagatatagaaagctctaagagttgctacaggagatagaattgaaactatacataggctgaggtgggcactgcggaggattggctatgcgagggtattaatgtggtgcggctgtacctgcctgttttgtgaaagtcacttctctgagactgtgaaggtgagaagcccagggatccactagaagcttcactgcggctctttggtgggggaaagcattcccagtggtagctgtcctcatttgcagcgttattctcggaaaccaagtatgtgcagcagtgacagactatgccacagctcctctgcagtttggaagctggaacaaatggaaagagcttatagccaagagaggttgtgatttttttttttttaccatccaagctttctctggcagtgcacaaatgaaggatgagctttgtggcaagcaaaatcagcagactgcctgacagggggttttgatcgaacggttggaagtaagcagccttgcccaaacatccagtgcagtggcctccagtaccgatggcagcatccacacagactctgtggatggaacaccagaccctcagcgcacaaaggctgccattgctcacctgcagcagaagatcctgaagctcacagaacaaatcaagattgcacaaacagcccgggacgacaacgttgctgaatacttgaagcttgccaacagtgcagacaaacagcaggctgcccgcatcaagcaagtctttgagaagaagaaccagaaatctgcccaaactatcctccagctgcaaaagaaacttgagcactaccacaggaagctcagagaggtagagcagaatgggatcccccggcagccaaaggatgtcttcagggacatgcaccagggtctgaaggatgtaggagcaaaggtgactggcttcagtgaaggtgtggtggatagtgtcaaaggtgggttttccagcttctcccaggccacccattcagcagcaggcgctgtagtctcaaagcccagagagattgcctcactcattcggaacaaatttggcagtgcagacaacatccccaacctgaaggactctttagaggaagggcaagtggatgatgcggggaaggctttgggagtgatttcaaactttcagtctagcccaaaatatggtagtgaagaagattgttctagtgccacttcaggctcagtgggagccaacagcaccacagggggcatcgctgtaggagcatccagctccaaaacaaacaccctggacatgcagagctcaggatttgatgcactactacatgagatccaggagatccgggaaacccaggccagactagaggaatcctttgagactctcaaggaacattatcagagggactattccttaataatgcagaccttacaggaggagcgatatagatgtgaacgattggaagaacagctaaatgacctaacagagctccaccagaatgaaatcttgaacttgaagcaggaactggcaagcatggaagaaaaaatcgcgtatcagtcctatgaacgggcccgggacatccaggaggccctggaggcatgccagacgcgcatctccaagatggagctgcagcagcagcagcagcaggtggtgcagctagaagggctggagaatgccactgcccggaaccttctgggcaaactcatcaacatcctcctggctgtcatggcagtccttttggtctttgtctccactgtagccaactgtgtggtccccctcatgaagactcgcaacaggacgttcagcactttattccttgtggtttttattgcctttctctggaagcactgggacgccctcttcagctatgtggaacggttcttttcatcccctagatgatgctggcacagaaggcattgttccctaccctctggcgagtgcatgcagcagagagttagacagcaacttacctactctgaagttttctacaacaaaaaaagagttgagtgaatctgtttacatttagaataatgtttttttcttcaagagacgcaattgcaatagtattttttagattttatccaagaagttttttgggcgaaaatcttggatcatttttatgtagcatgattttccttgggatgcaaatcttaaaacagtcctttaatatgaaccaacaatctggagcacaccgaagggcaatctaaattgtggcttgaaggactgcactaaaacccactaaaaagatgcgaaaacctgatgagggcaaaccagttaaacctaacaccctgccttgtctgggctcatcacctctccctatcccagactaactttactgtgaaatcctaccacattccatgtctgaatttttggattcggggtggattttcgttgtccgtggaagaacacatggatctctctggctttctcacccaagttggccacttacgctaatcctggaagtatgatcacttttgaacctgccccttaaccttgacgaggatacaaaagtgaaagcatcatcccccaaaggatcactgcacagtcctactacagtatttttaagtagccctctaaatacttaattttaagcaaaatcccttggccgcacttttaaggtttttttatatgtgtatagttaccaacctaaaaataaaaaatccgaacagcatacttgaagaatgtaatactcaaactctcagtgcttccttatggtttctaataggattttttattattgttattattattattgggtttttttggacagggttgggagggtcttttatttttcctttgaaataaagaagtgatgtttttaaatgaagaaatgtgtggatatttaagtgtgctgctccctcttgtcttgaaacagtttgagtaagaaagtcttgctgtaaatgctgccctctgccgcctttgttttgagatgcagtttaaactccctctggctgctgctgctgctttttggtgtcccgacatacctacgcccccgttttatgggtttggcttagttgaagaggaaagggttgtgcaaggagagcaggaggctgtttccaaaaaccagtgtagtaggatagggattttttttttttttttttgccccaagaaaacgttcacccagtgatcttgggctggggttgtctttaggaaaagttgagactataagagtcataaataagtccttgtgtttccttaatttattttgttaacacccctaattacaaccaaagtgatgatgtggagtcttctgtcttcattttggccccagcattcttaatttcaaagctttattctgtctgcctaagagaatcaaccaaaggtgattctcctaaagagcagtgaaggaaatgtcaggttagcaggacccaagttttgggtgtgaaatgttgccagcttcctataatgtaaacggacttgttaacctaacctaattatgctcagtggacttctatagatggttttgaaaaatgaactgagctgccttcccccgtcgcataaccagttccatcatcctggtggaacttgaacatttagagtttatctagagagcttggttaatctttccatattatttgtagtattggtcacaaatgctgttccctcttagcctcattctgtgcaaccaagtgcatataagatgccctgaaaagagtaacaaagtatgctttgcctgtttccacttaccaggaaattccttcagaactagattagcattgccctgcctgtctgaaaggacagtttacctaatggtgccagcctccttttgctttggcaagctggatttctcagagccagcatgttgtttccataactactttgatattttaactcaggtactccagtcttcaccccaacctcagctgattgtagtacacctgctagctctgttgccccctcaaaactgcacccagagcagggccacaagggtgctttttttctttaaaaaaaaaaaaattagaaccaattcatgttcatgccaaaaacaaattgtccccaagcctatatgtattaaaatgttaactttgcctaaaaatattgcagtgactttttaggcaggagtgccaaaggacactatgaactttttgaactgacagtttctcctaactttctgctttagcgtaattgctcagagtagagagcccccacaaagttatttaaaagatgccctagcagcaatccaccagtttttctaagctagaacctttgagtcccccaaactgcctgaagacttaagttttgtgggcactggaagtcactttgatagatggattgaaactgttcctatttgccctgggacggtttctatctatcaaaggaaggttttcacctgtagaaagccccctgcctccagccaaatagtcccatgctgactttctatcttcctttctcaaactgtcttaggaaggaccttcagtgcagatcaggtgcagtaatggctttcttgtcccttaattattcaccagacccagaagttgtacgcatttaatgctgtttgtaaccatgcatctgttttcattctttgctgtaccttttgctgcccatcctgttacttttgagtttctttcattgtggttgttcttgggttcttttgtcttgtcagagctcttctataacctcgctctaatggcttaacagttgttctgggtggaaacgtcccctcatttgaatgctcctctaaaaaaaaaagaaaagaaaactgtattcattccctttaaaatgaaacattcctggtttatttgtccatgcctctagcctgggtgagtgaagctggctgtgttggcctgggtgattgttcaggttgtagaatgcgcattttacattgtttatgataattgaagggtacttctgtctgctccaatttccattccttggtatactcagtatgtcctagtaaggaaggctttccactctactggctccttaagaagcaaaagtaggttaaattttatacttcactgactagggtcttctctctcccctgttctgaatggagtaaaagtctgatgccaagacaaatattgggagcgagccttcctcactagccatgtccaaataatgagcgtattttcatgtggtcttcactgcatttggttttgtttctgatttcatgttcctttgaggtacagtcagatgaaaatgctgagttctgagagagttccaatgaggagctgcctttcagctttggaaaatatgcaactaaaacaaaaccaaacattattgtaatctgacacaggcaaaattatggttcccacaccccaaccccaaatgaaacctgggattttgaatgtggctctaagagttaacattgctgtctgtatgtcgtgtatgctaggtgatatcctcagtagggattgactactagactgtgtgttttatcaaagtgtgtaagaataaaaactcacttgcacgaattgaaacgtaaagaaatgacacttgtgaacgtgtgaacgttaacactgtagttgatagatcttaagctgctaattgttgagagagatttaaatttatgttctgtctggtcgctgcagattctcagcagcacttttactgtatatagaaattgaaataaagacctcagctattaa

SEQ ID NO: 7023 - DNA, 2818 bp, Homo sapiens
aagtgggtgcagaatccatgtctttctgaacgacagttctgctgtgagaagctgccattagagagatccagcaggccccaggactcagctggccagccggtgacactgctcactgctcattgtcctcagctgtggacctctgtccccctctgctggccactcacagaatttcctgctggcactgtcaagatgaagtccaaggaggaagagactgctgtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacca

SEQ ID NO: 7024 - DNA, 2674 bp, Homo sapiens
atgaaccaggttgttcagcccttaatgagcagacactctgcatgtagaggcagccaggcccacctctcatgggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacca

SEQ ID NO: 7025 - DNA, 3738 bp, Homo sapiens
ggccggccgggagggatgcgctgtgccgcccagctcctctccgtcctgcccatgccctgaagcagaaagtttgggggccgggggttgtctcccttctccctcctgcaatgactgcccaaggactcttgctgcccagcctcgactgtgacctgtcttcgctccccaggtcgaaatgaactattccaagctataaccaaggctcccccttctcgcccctccctcacccgcctttaagaattttttttttaattcaagaaattgtggtctgccatctcccctccttgttaataatttagaccccaggcctcatatgaatataagagggggtgcggtcttccccaagacggcgcgctggaaggacagattccccttgccgacccacatacaccatgaagaggtgcagatcggacgagctgcagcaacaacagggcgaggaggatggagctgggctggaagatgccgcttcccacctgccgggcgcggacctccggcctggggagaccacgggtgctaactctgctggcgggccaacttcagacgccggcgctgccgcggcgcccaacccaggtccccgaagcaagcctcctgatttaaagaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctgaagggagcttagaatgcagccctacctggagatagtgcgggcacctgtggccaagtggagcagaggtggacatggggttggattgttttgattatttatagttacacaaggacttctcccagctgaccctcaggatgccccaagtcaggaagaccattaagaataggaggagagggctctgcctcaactttcctaggaaagagcccacctcggagatagctacggttttctctggtggagatggtgaggatgaaggctggagagtgagggaggaggctctgctggccgcagagaacacagggatgggagggtccctagccttcgggcacctccagggccagagagcaggctcagagcagctagtgtggagctcagcatccccaccccacccctcctccctgtagagctgatttgaggcctccttctggggctgggctctgcaggccaggtgggtgtggcctgtgttttcccttctgttctttctgcctgtactggatctgttattttcagggaaacaggccccagggcccccctgagcctcaccctaagcccttaggcctctgagagtgctgttgggttctatttatttatttatttgttcctttgttccctacccgtgcccccagtgtcttccctgctgagtaccaggagaggtcctgccccatcctctctctgaagccagggcccttccattccatttagcctttggatcatcctggctgggagaagtgggaccgagccacccagccccactatccccaagcagccctacagccgggatgggaggcacgtggcctctcttttatccgtctatttattttgtaagtgtattcgtgtggaggaggttgttgctttatttttttaaggctctggagtgttgtgtatggtttcttttcacatcccagcctcccatgggcacttctaagaagagaggggatttcttggaaaaggagagaggaatcccctagagcagggaaagcagtgcctgccagctgttgtgcaccttcctgagaaataaatatcctctaaattttcaaacca

SEQ ID NO: 7026 - DNA, 892 bp, Homo sapiens
tgaaccatttgcaagcctagcctccactggggagaagtctgttctcagagtgaggagctctgcacgcgttggctaaaagggtggcgtggctttgtgaaattgagagctggaggagcccagcagaatgaaccaggttgttcagcccttaatgagcagacactctgcatgtagaggcagccaggcccacctctcatggctgtggacctctgtccccctctgctggccactcacagaatttcctgctggcactgtcaagatgaagtccaaggaggaagagactgctgtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatggg

SEQ ID NO: 7027 - DNA, 2300 bp, Homo sapiens
accatttatgcctctgtctttcagctccgtgtcaggtctctgtgtttgttccccattattcagcaagcgttttagtgactcacccatccgagattgtttgaataatgtgtgaagtgttattcgcagacaaagggctggagaaatccaagatgctaaccaaaaagtggacagcaggtgaccattagttttccttgctgaaaaatccagcagctgtcagagggctccatgtttggccacggtctgaagcacctgttccacagccgccgtcggtctcgggaaagggagcaccagacgtctcaggattcccagcagcatcagcagcagcagggtatgtccgaccatgactccccagatgagaaggagcgctctccggagatgcatcgcgtctcctacgccatgtccctgcacgacctgcccgcccggcccaccgccttcaaccgcgtgctgcagcagatccgctcccggccctccatcaagcggggcgccagcctgcacagcagcagtgggggcggcagcagcgggagcagcagccggcgcaccaagagtagctccctggagccccagcgtggcagccctcacctgctgcgcaaggccccccaggacagcagcctggccgccatcctgcaccagcaccagtgccgtccccgctcttcctccaccaccgacactgctctgctgctggccgacggcagcaacgtgtacctcctggctgaggaggccgaaggcatcggggacaaggtcgataagggagacctggtggccctgagcctccccgccggccatggtgacaccgacggccccatcagcctggacgtgcccgatggggcaccggacccccagcggaccaaggccgccattgaccacctgcaccagaagatcctgaagatcaccgagcagatcaagattgagcaggaggctcgcgacgacaatgtggcagagtatctgaaactggccaacaacgcggacaagcagcaggtgtcacgcatcaagcaagtgttcgagaagaagaaccagaagtcagcccagaccatcgcccagctgcacaagaagctggagcactaccgccggcgcctgaaggagattgagcagaacgggccctcgcggcagcccaaggacgtgctgcgggacatgcagcaggggctgaaggacgtgggcgccaacgtgcgcgcaggcatcagcggctttgggggcggcgtggtggagggcgtcaagggcagcctctctggcctctcacaggccacccacaccgccgtggtgtccaagccccgggagtttgccagcctcatccgcaacaagtttggcagtgctgacaacatcgcccacctgaaggaccccctggaagatgggccccctgaggaggcagcccgggcactgagcggcagtgccacactcgtctccagccccaagtatggcagcgatgatgagtgctccagcgccagcgccagctcagccggggcaggcagcaactctggggctgggcctggtggggcgctggggagccctaagtccaatgcactgtatggtgctcctggaaacctggatgctctgctggaagagctacgggagatcaaggagggacagtctcacctggaggactccatggaagacctgaagactcagctgcagagggactacacctacatgacccagtgcctgcaggaggagcgctacaggtacgagcggctggaggagcagctcaacgacctgactgagcttcatcagaacgagatgacgaacctgaagcaggagctggccagcatggaggagaaggtggcctaccagtcctatgagagggcacgggacatccaggaggccgtggagtcctgcctgacccgggtcaccaagctggagctgcagcagcaacagcagcaggtggtacagctggagggcgtggagaatgccaacgcgcgggcgctgctgggcaagttcatcaacgtgatcctggcgctcatggccgtgctgctggtgttcgtgtccaccatcgccaacttcatcacgcccctcatgaagacacgcctgcgcatcaccagcaccaccctcctggtcctcgtcctgttcctcctctggaagcactgggactccctcacctacctcctggagcacgtgttgctgcccagctgagtggccagccacaccaaccctgtgctctctggcccccagctggccacacttctccaggagggacccttggacttctttgtgtgtccagtttggcctcctgcccaaactgtccattccagcagctcctgcccccttctctgtacttgcttctgtctgacaccttctccctgttggcctga

SEQ ID NO: 7028 - DNA, 5877 bp, Homo sapiens
gcaccagaggcaacagctgcagcagccgcgccgccccctcgcccgcggctcccagggtgatcccgagcacagccggtggctcgcggcgcggcagccccagaagacgggaaagttcgcggccggagcgcggagatgccgggcagcgacacggcgctcaccgtggaccggacctactcgtaccccggccggcaccaccgctgcaagagccgggtagaacgtcatgacatgaataccttaagcctgcccctgaacatacgccgaggggggtcagacaccaacctcaactttgatgtcccggatggcatcctggacttccacaaggtcaaactcactgcagacagcctgaagcaaaaaattctaaaggtaacagagcagataaaaattgagcaaacatcgcgcgatgggaatgttgcggagtatctgaaactagtgaacaacgcagacaagcagcaggcgggacgtatcaagcaagtctttgagaagaagaatcagaaatcagctcactccatcgcccagctgcagaagaagttagagcagtatcatcgaaagctcagagagatcgagcagaatggagcctctaggagctcaaaggacatttccaaagaccacctgaaggatatacatcgctctttgaaagatgcccacgtgaaatctcgaactgccccccattgcatggagagcagcaaatcgggcatgccaggggtctcacttactccacctgtgttcgttttcaataagtccagagagtttgccaacctgatccggaataagtttggcagcgccgacaacattgctcacttgaaaaattccttagaggagtttaggccagaggcgagtgccagggcctacgggggcagcgctaccatcgtgaacaaacccaagtatggcagtgatgatgaatgttcgagtggcacgtcaggctcggccgacagtaacggaaaccagtcgtttggggctggtggagccagcacactggacagccagggcaagctcgccgtgatcctggaggaactgagggagatcaaggatacccaagctcagctggctgaggacatcgaggcactgaaggtgcagtttaagagagaatatggttttatttctcagaccctgcaagaggaaagatacaggtatgagcgactggaggaccagctgcatgacctgacggacctgcatcagcatgagacagccaacctgaagcaggagctggccagcattgaggagaaggtggcctaccaggcctacgagcgctcgcgggacatccaggaagccttggaatcctgccagactcgcatttctaagctggagctccaccagcaagagcagcaagctctgcagacagacaccgtgaatgctaaagttctcctggggaggtgcatcaacgtgatcctggccttcatgactgtcatcttagtgtgtgtgtccaccatcgcgaagttcgtctcacccatgatgaagagtcgctgccacattcttggcaccttctttgccgtgactcttcttgctatattttgtaaaaactgggaccatatcctgtgtgccatagaaaggatgataataccaagatgaagccactggttcctgccttcaagttctttcaagtttttattttaaagaaaactctgtgcatactaccaaattttacagtgaatgattgtgcggactcgtgtgtaagaaaaactaggactgtgtggtgtaaataactacaattctcttaactccgtagcagttgccaactcagtccttgtacttcgttaacacgaatctgtttcagagctctcctaccttgctcactgccttaatcagaccgatttcctgcccacctgaccagcccagcgtggtaaacctctgtatattgagaccttggcataattggtgatcctgaagaaagaggtctctctcctaagtctctgtcagaattgagcttcacaattgctaatggttgttttctgtgagtcctataaaaagcaaggatatgcatgattcagggaatgaagaatcacaggcttgggcagtgttaaacactgtggcctatggtccccgtgtgatccaccctgcttctctccaggggaccataggtcccgtcatgtactcagtgtccacagcagtcagtcgtgtatgaccctgtaacgtggaaatcttatcacacacctgttatccaacaagtctacctgaggggttttgttacactttaaatgggaaggcatagggatttatgaatggggctttcaccttctcatacccaggcaaccaacacctgattttgtctcaactggctagcaaatgcccagccttcagagtgtgcaggaatgttttcaaatccctcatcagactgtgactttaacattaatttggaatcctgtgagcactactctgaaggtttgtgttttggcaaatcttttttcttttttgagacagggctctgctaaatattgctcaggctggttgcaaactccttgcttcaagggatcctcccacctcagcctcccaagcagccgggactgcaggcacaagccaccatgcctggctgttttttggcaaatcttgattgtgataagcccccctggaggatatgattcactttatgtgattcatcttattcacaggtctgtgagggactgcaaagcttactcaggaaatgaaaacaaatgatggtcatgttgcagttttttccttgaaggacaaccgaaccatagcctctaaagttcaagtgcactgaggtgtcggaacgctgaaagcatgaggaaacgaggacgtagggtgtgactgaatggtggctagattagtgggagcagttcacctggatgaagattgagagcatcgtctttgagaagtgaaagactagcaagaataaaataaattaagtccagtgtttgagccaaggttgccacctgtctcttaacatctcactgaacataagtcctgaggtattaggacgaccatactgcctctgagctgaaaacattcaaaagttcacatccctgtttgggggataccattcaccgccttcagcccagatgatactttcctttaaatctgtgtctctgtgtgtataacaaagaggaagatggaaacaatgttcatggaaactgctgttgagccccttgtcccaccactcccgccatctgctgcaggcaggaaggcatgtgagtgtacgttttcttccaggagacatcaggtccccctggattcaaattaagtgcaatattttgcaaacagctcttcttagggaaatctcctgaaggaaaaaaatgtgacagaatgttccatagtctgagagaatggaatcgttgagcatttagtacaagtccagtgtgtgtgagcgggacttaggcagctcaagcttgcttttttttttaagcgtacaattgagtggttttagtaaattcacaaacttgttcaaccatcaccactatctaattccagactcacgcttttttaaacaataaatgtcatttcatgaaatctttggtgataaagtattttggattcagagaagagctcccttaccagtcccaccctgatctcatggctgtctctcctttcattgtcagactccccctggtctaccgcgttgatgtgtatacactgatctttcaagtctgggagacagataaggaggccaggtgcaaggcagggaggcagagagaatgttgtgcttcctttagcttttgtatttcgatggccagcattaccctttacctgtgggcatcagactcagcgtgggctgagtgctgagtgtaacttacactcctaaatcaagctggggcctgggtgggcccctcttggtatctgtgaatctttccaagcaccacttcggacacaccagggattgagtgctgctgttagtttagagaaggagagatgtctaacccttgaggtgaagggctctgggagggtccaagaagacgtaggcttcattttcacaccagcccacaccattccagtgctcagcctagcaaatgtgctttaatgcacacttctcagacctgtgatccgtgtatcttctccccagtgacagaagtagagaagagaatggaaagcagcacactccgtcccctctagtctggagctgttaacagaatctgctagaaactagctttattctaacataccgtaggatctaaatcctcctacctggatcatgaattcctttgaaataattcatattttcattgactctcactaaatgtcaaataaccttgttttcacttggataggctcaacctacctggcatatttattttgcagtcttgttgaaagttcatgaaactttgtactttttaataagatgatacactcgaaggaaacttttaatctctgcagtttattctctcttaaggaataaacactcccactgtttgttctcttcaatgtgtaaggagattaaatgacattttagaaatattacaattaaaaatagtgatgtagctgtaacatatgctggaattggatatttaatttatgtttgtgtcaactataatcctttccccacccctttcatttatggtaaacatcttgggcaaacccaaagatggaaagtgcttgttgggtgggtaagcaccacctggtctctcagcaaacactcctgagtggttgaagatgctggacattggattctagcactgggtttatctggtgacatagtctcctgtgggtcttgagttggttatttcaagctcaaactctgaatatgattaaaccagaacaccccacccccaactgccaaaaaaaaaaaaaaaaaatggaaatccataatgaaacagcaaaaaagtactccgttgctgggtttggacaatgaacatgggattagtcccaagtttgtagcttggaacggtagcatttttgcctgcgtgatccttgtcagctattcacagaaggaaatcttccgaaactccgtctttcatttcagccggtgaggctgttatccttctctgtcaattagcattcatgtggttttcgctctttccagctctgtcactcttgttttcatttaaatattgccccactctgtgtttattgccttgccatttctctagcatatcaggtttaattatgggctcagtaataatgaggaactagcttccctcaggcaactaattacttttgtcttttttggtcggattgtaccaaattattttgcattgaatgggaatgtttttgcagtgaatccagatatagttgtattggtttggaaaaacatttaaatatatttattcatatgaacatgtgtgattaaacaacctattttacatatttctgtaattctgaggagtgggctgggggtaggaagaaatggcaccacttaaaattcagggcttatatgaagaggtgttttaaggttagcacatgcacaaaggaacgagttggtttaaaaagataaatcactgcaaagaatgaaattggcttattcacatcaaaactagataagatgctaaaaaaaaaagatatgaaacagaactaacctatagtttcctgaaatcagtacagtttaatttataagaagctagaaagtaatgcaccttgattgttttaggaatgatttatgtgttgcaattttaatttatttaaagcatgtctactgtgtttgtcctaagagaaatatttcaacaaaacgtgctctgtgtttaagatatgtttaggcagtagttagcaactctgaaagtagaaactggaaatgtttattgtgaggcttgttgcagaatttccattttgtgagttactacttagtttcatgtcagcctaaaattgtaaattccctgtagatcttcaccccattgtggtgtcatcaatgaatccaaagcaggtgccattatttttttaaataaacacttgatgttagctttggtgttaaataaagaggtagatttcttaaatttt

SEQ ID NO: 7029 - DNA, 739 bp, Homo sapiens
ggaatacctaggcctccagactactccccctaactcatatttagattcctgaagcttctgcacatgtagttcctagagctgctgcttattaaaatgtcaacatcttcatcttctagctgggacaacctcttagagtctctctctctcagcacagtatggaattggatacaagcaagttttttgggagagactagtgcacctcagcaaacaagtttgggactattagataatcttgctccagctgtgcaaatcatcttgaggatttctttcttgattttattgggaataggaatatatgccttatggaaacgaagtattcagtcaattcagaaaacattgttgtttgtaatcacactctacaaactttacaagaagggctcacatatttttgaggctttgctagccaacccagaaggaagtggtctccgaattcaagacaataataatcttttcctgtccttgggtctgcaagagaaaattttgaaaaaacttaagacagtggaaaacaaaatgaagaacctagaagggataatcgttgctcaaaaacctgccacgaagagggattgctcctctgagccctactgcagctgctctgactgccagagtcccttgtccacatcagggtttacttcccccatttgaaatgtgatggactccaatcttttccaggaaagcactgtttccctcatgtgtgcagtggtgtatcaataaagatagagaacgctattgaaattaccgt

SEQ ID NO: 7030 - DNA, 3050 bp, Homo sapiens
aaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggacgggcgggcgcggatccctgcgtcccgctgaaaatgtgtgtctgacatgcaagctcagtggggcagagacccgtggattgctgtgccctgccctccggacctggatcatgaaggtgttgggaagaagcttcttctgggtgctgtttcccgtccttccctgggcggtgcaggctgtggagcacgaggaggtggcgcagcgtgtgatcaaactgcaccgcgggcgaggggtggctgccatgcagagccggcagtgggtccgggacagctgcaggaagctctcagggcttctccgccagaagaatgcagttctgaacaaactgaaaactgcaattggagcagtggagaaagacgtgggcctgtcggatgaagagaaactgtttcaggtgcacacgtttgaaattttccagaaagagctgaatgaaagtgaaaattccgttttccaagctgtctacggactgcagagagccctgcagggggattacaaagatgtcgtgaacatgaaggagagcagccggcagcgcctggaggccctgagagaggctgcaataaaggaagaaacagaatatatggaacttctggcagcagaaaaacatcaagttgaagcccttaaaaatatgcaacatcaaaaccaaagtttatccatgcttgacgagattcttgaagatgtaagaaaggcagcggatcgtctggaggaagagatagaggaacatgcttttgacgacaataaatcagtcaagggggtcaattttgaggcagttctgagggtggaggaagaagaggccaattctaagcaaaatataacaaaacgagaagtggaggatgacttgggtcttagcatgctgattgactcccagaacaaccagtatattttgaccaagcccagagattcaaccatcccacgtgcagatcaccactttataaaggacattgttaccataggaatgctgtccttgccttgtggctggctatgtacagccataggattgcctacaatgtttggttatattatttgtggtgtacttctgggaccttcaggactaaatagtattaagtctattgtgcaagtggagacattaggagaatttggggtgttttttactctttttcttgttggcttagaattttctccagaaaagctaagaaaggtgtggaagatttccttacaagggccgtgttacatgacactgttaatgattgcatttggcttgctgtgggggcatctcttgcggatcaaacccacgcagagcgtcttcatttccacgtgtctgtccttgtcaagcacacccctcgtgtccaggttcctcatgggcagtgctcggggtgacaaagaaggcgacattgactacagcaccgtgctcctcggcatgctggtgacgcaggacgtgcagctcgggctcttcatggccgtcatgccgactctcatacaggcgggcgccagtgcatcttctagcattgtcgtggaagttctccgaatcctggttttgattggtcagattcttttttcactagcggcggtttttcttttatgtcttgttataaagaagtatctcattggaccctattatcggaagctgcacatggaaagcaaggggaacaaagaaatcctgatcttgggaatatctgcctttatcttcttaatgttaacggtcacggagctgctggacgtctccatggagctgggctgtttcctggctggagcgctcgtctcctctcagggccccgtggtcaccgaggagatcgccacctccatcgaacccatccgcgacttcctggccatcgttttcttcgcctccatagggctccacgtgttccccacgtttgtggcgtacgagctcacggtgctggtgttcctcaccttgtcagtggtggtgatgaagtttctcctggcggcgctggtcctgtctctcattctgccgaggagcagccagtacatcaagtggatcgtctctgcggggcttgcccaggtcagcgagttttcctttgtcctggggagccgggcgcgaagagcgggcgtcatctctcgggaggtgtacctccttatactgagtgtgaccacgctcagcctcttgctcgccccggtgctgtggagagctgcaatcacgaggtgtgtgcccagaccggagagacggtccagcctctgatggctcggagatgatggaccgtggaagggaagcgtctgtggggagtgagcgcttagatggccagcagctgctccttctgggaagctcgcaccttggcaacagaacagccctctagcagagcgtcagtgcagtcgtgttatcccggcttttacagaatattcttgtcctattttagaattttccggagtagtttatttgcagtctgttgattatgtgcagtagacccgggacactgcgttttaccgatcaccttgaatgtggtgcctggatgtgccttttttttttttccctgaaattattattaattttctattgtgagttcatcagttcatagtttttttagtaaagaagcaaaattaaaaggcttttaaaaatgtacaacttcagaattataatctgttagtcaaatatttgttattaaacatttctgtaatatgaagttgtaatcctggccgtgagcttggaagcttacttttgattcttaaagcctatgttttctaaaatgagacaaatacggatgtctatttgccttttattgtaacttttaaatgaaataatttcatgtcaatttctattagatatatcacttaaaatatttggttttaaatcacaagaatatgtattctttaataaagataatttatgatcatggtataa

SEQ ID NO: 7031 - DNA, 2974 bp, Homo sapiens
cgggcgggaggagccgctcgccggttttgccgcctccgcctttgccttcgcagccgcctccagtgttgtacattataaaccggggctgctgatgaggagtggggaactggctctctggaacgtgtgacagcaggcagaagggggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgaggacgtcatcctgctgggtgcgcctgtggagggagaagccaagcattgggagcctttccggaaggtggtgtccgggaggatcatcaacggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcaggcgagaccccccaccaggttgggcaaacccagggtcccatatccggagacacctccaaattggccatgtccacagaccccagccaagcccaggtgccagtagggctggaccagtctgaaggggcctcccttcctgctgctgccagccctgaaaggccccccatctgcagccatggcatggaccccaacccactgggctgccccgattgtgcctgcaagacccagggccccagcacggggctggactgaccacagcaggggacctgagccgtcttccccagtctccatatgcagctctctcttataccctcgggttcctcccaggagctctggaggtacaggatttccacaggcctctttcctaaatggaaggaattggaactgaaagggaaaggaaatggaaggaaggggaatttggaggagagaacacgcccacccttgggaagctgcctgtccccagaggagccccaccagggagcagctgccccctcatcagagacctgcagagtcaaccaagcacaggttagagtcccaggaccggaaaccaactgtgggctttctgtacttctcatagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacaccactaacagagcatggtgaatacatgctgaattgcattcagtatggctgtgaactaggcctggggacaagaatgaattttacatggaaagaatttcctgtagcaggaacagaggggataacaacagcaataaataataataagaagaagctaccacttcttgagcatgtaccaca

SEQ ID NO: 7032 - DNA, 2806 bp, Homo sapiens
cgggcgggaggagccgctcgccggttttgccgcctccgcctttgccttcgcagccgcctccagtgttgtacattataaaccggggctgctgatgaggagtggggaactggctctctggaacgtgtgacagcaggcagaagggggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgaggacgtcatcctgctgggtgcgcctgtggagggagaagccaagcattgggagcctttccggaaggtggtgtccgggaggatcatcaacggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcaggcgagaccccccaccaggttgggcaaacccagggtcccatatccggagacacctccaaattggccatgtccacagaccccagccaagcccaggtgccagtagggctggaccagtctgaaggggcctcccttcctgctgctgccagccctgaaaggccccccatctgcagccatggcatggaccccaacccactgggctgccccgattgtgcctgcaagacccagggccccagcacggggctggactgaccacagcaggggacctgagccgtcttccccagtctccatatgcagctctctcttataccctcgggttcctcccaggagctctggaggtacaggatttccacaggcctctttcctaaatggaaggaattggaactgaaagggaaaggaaatggaaggaaggggaatttggaggagagaacacgcccacccttgggaagctgcctgtccccagaggagccccaccagggagcagctgccccctcatcagagacctgcagagtcaaccaagcacaggttagagtcccaggaccggaaaccaactgtgggctttctgtacttctcatagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacaccactaacagagcatggtgaatacatgctgaattgcattcagtatggctgtgaactaggcctggggacaagaatgaattttacatggaaagaatttcctgtagcaggaacagaggggataacaacagc

SEQ ID NO: 7033 - DNA, 2403 bp, Homo sapiens
caaacagagaattccaggagggcttggggagcctctggagaaaaaccaggctcctcatgttacaaggaggccatgtcttctggtgcccatgcctgaagttacaggagggaagaattactgctgctgacttttgagtggattttacagctgggtaaactgaggctcagagagggcaatttgcatatttctccaaagaaccatccagaacctgagcagcctgtcttcagacagagagaggcccacggctgtttcttgaaatctggcgctgggaatggccatgtggaacaggccatgccagaggctgcctcagcagcctctggtagctgagcccactgcagagggggagccacacctgcccacgggccgggagctgactgaggccaaccgcttcgcctatgctgccctctgtggcatctccctgtcccagttatttcctgaacccgaacacagctccttctgcacagagttcatggcaggcctggtgcagtggctggagttgtctgaagctgtcttgccaaccatgactgcttttgcgagcggcctgggaggtgaaggagcagatgtgtttgttcaaattttactgaaggaccccatcttgaaggacgacccgacggtgatcactcaggaccttctgagcttctcactcaaggatgggcactatgacgcccgggccagagtcctcgtttgccacatgacctccctgctccaagtgcccttggaggagctggatgtccttgaagagatgttcctggagagcctgaaggaaatcaaagaagaggaatctgaaatggccgaggcatcccgaaagaagaaagaaaaccggaggaaatggaagcgttatctcctgataggcctggcgactgtcggaggcggaacggtgatcggtgtgactggaggtctagctgcaccccttgttgccgctggagcagcgacgattattggcagcgccggggcagcggctctgggctcagcagccggcatagccatcatgacctcgctgtttggtgcagctggagctggcctgacaggatacaagatgaagaagcgagtgggagccattgaagagttcacgtttctgcctctgacggagggcaggcagctgcacatcaccatcgccgtcacggggtggctcgcttctggcaaataccgcaccttcagtgccccgtgggctgccctggcccacagccgtgagcagtactgcctggcctgggaagccaagtacctgatggagctcggcaatgccctggagaccatcctcagtggtctcgccaacatggtggcccaggaggccctaaagtacacagtgttgtctggcattgtggctgccctgacctggccagcctcactcctcagtgtcgccaatgtcatcgacaacccctggggggtgtgtctccatcgatcagcagaggttggcaagcacctggcccacatcctgctctcccggcagcaggggcgacgacctgtcaccttgattggcttcagcctgggagccagagtcatctacttctgtctgcaggagatggctcaagagaaagattgccaaggaatcatcgaggacgtcatcctgctgggtgcgcctgtggagggagaagccaagcattgggagcctttccggaaggtggtgtccgggaggatcatcaacggctactgcaggggagactggctgctgagtttcgtgtaccgcacatcctcggtgcagctccgtgtcgccggcctacagcccgtgctgctgcaggacaggagggtggagaacgtggacctgacctctgtggtcagcggccacctggactatgccaagcagatggatgccatcctgaaggccgtgggcatccgcaccaagccaggctgggacgagaaggggctcttgctggccccaggctgcctgccctccgaggagcctcgccaggcagcagctgccgcctcatcagctttggagtctggctgtccatcaggaggtcccgagggctctctggggcctgaggctcccacaccagctctcccctggcctcaataaaaccaggtgcatgcctgttcttccatccacactccagggctgcccaccagctgacaggcaccatcaactggcagcaacagagcaggcgcaggtacaaagaaggcagctcactcctgctcttaggagatccaatcagatctgccctgtacagccatgtaggctgtgcgctgcataactccagggacatgagtcacacagacacaatgtgagtgtgctcccccgtcatgcaacatctggacaccactaacagagcatggtgaatacatgctgaattgcattcagtatggctgtgaactaggcctggggacaagaatgaattttacatggaaagaatttcctgtagcaggaacagaggggataacaacagcaataaataataataagaagaa

SEQ ID NO: 7034 - DNA, 1274 bp, Homo sapiens
ggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaagattttttgctgtctctttttcatcaccctatttttcatcagactgctgagctacatgttttttcatgtaagattcataaatccagatctcctcgtcaatgtactgcccaaggtactgggcaggagcaccttgtggaagctcagatgcttcttctttccatctctcacacttgagacagaggacatgttaccccactgattccctaagaaatatccttgagcaatagaagggaagtgggatccgagcctgtagaagggaggcatgaaacttgtggaggaaagagatttgcttcagttttttcctcaccgtttgcctgcttgactaccttctgtcaccacgtcatctttccaggattaaccttgaccagtaaaaagctctgtaatagatttatgtggctctgtggatcggctgaatagtacttgatagtaaacaaatttgaccatttggggaattatatagatgctaagaaaagttaattgataaattattctagtgaatctcaa

SEQ ID NO: 7035 - DNA, 790 bp, Homo sapiens
gggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaactggcaccattccttctga

SEQ ID NO: 7036 - DNA, 575 bp, Homo sapiens
agaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcagcgcaaggggttatttaaggaagcaaagcttctcaagaaaccagagtgaaggtgcactgttagattgagcactttggaggagaaagcctgggaaagacccttgctgactgagctgcgaattatcgaaacagttgtagagcatgatcaagaaatgtaatttttcaagaatgaaaatggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctg

SEQ ID NO: 7037 - DNA, 839 bp, Homo sapiens
ggaagcatcacaggaaaagctttgggttttcatgccttcccttcatgctcctagatctgctggactctgtgtccatctcagcacaactggagggcttctcttgtccaccaagcttcttaccacatctacaccccacttaacgggtctgagaatgctcagtcgcttcttctgcgccaccctaattatacttgcaacaacctcctcactcttacctccttcacctgtttatgtttcctcatggcagtgttaccaagcaaaagagtgtcactgcccaatgtgctggaagccaatactatgacacaagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaagg

SEQ ID NO: 7038 - DNA, 1939 bp, Homo sapiens
agattagactcctcagaagctaattgactagggaaggatcaggaagacaagacacatcaaaaaggggagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccacgatggaaagggaaagagccttgcaggagctggaggaagaaacagccagacttgaaaggaagaataagacgttggtccacagtataacagaacttcaacaaaagcttacaaggaaatcacaaaagataaccaattgtgaacaaagcagtccagatggagccctagaagagacaaaggttaagttacaacagctggaagcttcctatgcatgccaagagaaggagctgctcaaggtaatgaaggagtatgcatttgtgacccagctctgtgaagatcaagccctctacataaagaagtaccaggaaacgttgaagaaaatagaagaagaactagaggctctgttccttgagagagaagtatcaaaactcgtgagcatgaaccctgtggaaaaagagcataccagccaaaataatgagggtactcctacccaaaagacagcaagattattcagtaaaaaatgggcctcctccttttagtggcaagatggctgccaacaatccagatctcgtactaccagattggcaacctttgcagaataaaagtcttttccaacaggttcagcagtaaagtccagaaaaggtcataaactggcctatctgaggtcaattgcctaccctgtcccacagtcaatgtggccagagggatggagtactctgattggtcaagcttatgtcatatgttcagccccttactaaggattaagagcagtcaaagaagaagaacaaagtaagggaatgacctaaactatatgaaatgcatttctcccactaaaaggggctcagtgcctatggaagagaaaagggatgctggacacgcaaaagcagaggtctacttcattgctaaactctgtgtcttcctataagcaaaaattataacttctaaagatagtagattaagacggtgaaagcttctacaaagagctcagtttaagaaccatgtaaataatcaggtcactagggctaaagtaagcaacaattctaaaataagtagaatatgactggtataaattgcttcaccaactcaaagtagcatatatatcacacctcttatttttccaattaattgctgaaacattcacatgccttactaataggatatactctacattattttccagtacaagagaaaattattttaaatggtaaggttttaggtctaaaagtgtctcaattttaagaaagctgatatcaagcaggtcatattttctaggcattgtgcaatgactatagaaattatgaaaatgtgtaaccaaccagtaatatctagccacaggcaaattttataaaagatccttttaattaacttctggattaaatggaaaatccaaactgagattacttttatagggtcagttacatgctaaggaggaagcatagagagtagaagaatggttaccagaggctgtaaccttcttaatttaaggtaaaaaattctacctattagcttagtattagatgaaaacagaaattcttgtcacatacaggcactattcactgcagtgaagtatatcttttcagaaagttgcataaaatcgaataaaataccatgtattaaatt

SEQ ID NO: 7039 - DNA, 579 bp, Homo sapiens
atactctggagtctgcatgccagattcatgccctcccctgagttctggccaggtttcttgaccagttcaaactgttacaaaattcagctggaggttttgctctccctgtggcattttccctgcgcctctggccaccctccagaaggatccctgtagtgccaagcaggaatggcctgcttggggacctagcaagctcacagggcctttcccattgcttcctctatccctgtattgtgttcagctctctacattggctcagctccagggaatctacaatggaaggacacaagaaagatcagctggattaagtagtcatgattatgcaaagccatatccagagaccaaggtgtaaagcaggtcggagaaaatggaaatctcaagattggctcagtcaaaaagaaacattatcagtttgaacatggaccttgaaagggatacgcagagaatagatgaagcaaatcagaaacttcttctcaaaatccaagagagggaagataagattcagaggctggaaagtgagatcattcagacgcggggcctggtggaagatgaagagtgggagaaggagaaccgcaccac

SEQ ID NO: 7040 - DNA, 4816 bp, Homo sapiens
tacactccagtcatggcggcccgacaggccgtgggcagcggggctcaggagacatgcggtctggatcggattttggaggcattgaagctgctgctgagcccgggaggctcgggctcaagttcactacaggtcacaaaacatgatgtcttgttggctactttaaaatctaacctgtctgctttggaggacaagtttctgaaggatcctcagtggaagaatctgaaactcctaagagatgaaattgctgataaggcagaatggccacaaaactctgtggatgtcacttggagttttacctctcaaaccttgttgttgcttttgtgcttgaaggaaaccatgatccgccttgcagctaatttcaatccaggtaaacccaaccctaggactccggaagttgctcctgccctgagccccgatgcacttagtatctcacaacagaagactgtccagttcgttttgcagtttgtagttaccttgggtatctgcccctatctcatgcctggtgttggagtccctttgagatatagaactgaatttggtgccgtcgttcaagacgtggtgtgttttgatgctgcccccgatgcaactcgaagactgtacaccagctgcaaggcccttctgaatgttgctcagcacacatctctggggagcttgatcttctgccaccactttggggatatcgcagcaggtctgtgccaactgggattctgcccaaccaaaagaaaactgctaacacctgcagaagaggttctaactgaagaggagagaaccctatccaggggggccttgagagacatgctggatcaagtctatcagcccttagcagtccgggaactgcttatcctccagggaggaccaccccagtcctgcacagatgtgaagacacagatgaggtgtcgggccccagcttggcttcggcgtctatgtggacagctgctctctgaaaggttaatgagacctaatggtgttcaggcagtagtccggggcattttggaaggagcaggtgcgggagcagctggtggaagtgatgctgaggtgacggctgctgactggaagaagtgtgacctgatcgcaaagattttggcctcttgtccccagcagtctctttcaccagagaattactacagggacatctgcccccaggttctggatttatttcactttcaagataaattgacagcacgacaatttcagagagttgccaccactacctttataactttgtcaagagaacgcccacatttggcagcaaagtatttgctccagccagtgttagctcctcttcatcgatgtttgaatacagcagagctttcagagagtgacatggtaccaggaactattttggtgacagaagaagaacttagtagatgcattgaggatgtgtttaaggtgtacgtggttgggaatgaacctttaacagttttgatggattccctgcttccagtcctgggagtgctttttcttctctactgttttactaagcagagtgtgtctcacataaggtcactttgccaagaaatcttattatggattctggggaagctggaaaggaagaaggcaattgccagcctgaaaggatttgcagggttggacaaagctgtgccctctctccattctctgtgtcagtttagagttgccactcaaggtggcattatgattaccatcaaagaggccattagtgatgaagatgaagatgaagccctgtaccagaaggtatcctctgagcagggccgggtggagcatctcggggacttgctgtcccactgccaggaatgcggtttggcaggagacttcttcatcttctgtttgaaagagttgactcatgtggcctcggaaaatgaaacagagttaaaaactgagcccttctccagcaagagcctcttggaattagagcaacatcagactcttcttgtggaaggccaagagcggaagctgcttgtcctgcagctgatggctgttctgtgcgagagaatgtctgagcagatattcacaaacgtcactcaggtggtggactttgtagcagcaacattgcagagagcctgtgcaagcctggcccatcaggcagagagcaccgtggaatcacagacgctgagcatgtccatggggctggtggctgtcatgctaggaggagctgttcagttgaagtcaagtgattttgctgttctgaagcagttgttgcctctgttggagaaggtatccaacacataccctgatccggtcatccaagaactcgctgttgatctccgcatcaccatctctacccatggagcctttgccactgaggccgtcagcatggctgcccaaagtacactgaacagaaaagatctggaagggaaaatagaagagcagcaacaaaccagtcatgaaagacccactgatgtagctcatagccaccttgaacaacagcagagccatgagacagccccccagacaggcctgcagtcaaatgctccaatcattcctcaaggagtcaatgagcccagcactactacaagtcagaaatctggaagcgtaaccacagaacagctccaagaggttcttttgtcagcttatgaccctcaaattccaacacgggctgctgccctgcgtactctttcccactggatagagcagagagaagcaaaagcccttgagatgcaagagaagcttctcaagatattcttggaaaacttggaacatgaagacacttttgtatatctatctgcaattcagggggttgccctgctgtcagacgtctatcctgagaaaatcttgccggacttgttggctcaatatgacagcagcaaagacaagcacacaccagagaccagaatgaaagtcggggaagtccttatgcgaatcgtcagggcattaggagacatggtctcaaagtaccgagaacctttgatccataccttcctgaggggagtgagagatcctgatggtgctcacagggccagcagcttggccaaccttggggagctgtgccagaggctggactttctgctgggctccgtggtccatgaggtaacagcttgcctgattgctgtggccaaaacagatggtgaagttcaagtacgcagagctgccatacatgtggttgtgctgctgcttcggggactcagccagaaagctactgaggtgctgagcgccgtcctcaaggatctctaccacctgctgaagcacgtagtgtgtctggagcccgatgacgtggccaagctccatgcccagttggccctagaagagctggatgacatcatgaaaaacttcctgttccctccacagaagctggagaagaagatcatggtcctgccgtagacctggctccaaggacgtggaggaggcaggcagggccaggcacccagagccgtgcccaggtcttccagcaggtggccctgctgcctcttgagtgctggcagcatggctgaccctcggggtggttttatggtgcaggtcacttgggtcttcagggtcccttccgagggcatgtgttcagcactcccgcgttcagcctgaggggtgtacagttaagagaagacagttacagatctcattaatctacatttttcactgtcctctagcattgaaagaaggatgtctacctggtgaaagtatattttaacatgactgatggaatttcactaattgcccactctcttggaacttgaggagaagcggttggccacccatatgtcacctagctctatattctttcaggctgagattcttcttcaggaaaatgaggagcagaactggccacccttggctgctcaagaggcatttcagagtaggagatgcagttggaggtggggaggggaaggaaatagttatcaaataatgcaaaatggaataaagttatcttggatggaaagaacagggctaaatctggtcctctggtgtcgagatggaaaactgtggagttgaagaggctctgatgcccagaaaggacaatcaagctggttgactcttccagagaagaagggtaagccctgtatttatcctcccaggccattcttcttcactcctgctgctgtttgcagagagttgccctgattatcaggagaaaagaaccacgagcatccagagagtttacatcctgccttctgtcctctgctccttcagaaagatgaatgcctagacaatgggttcacactgaatgcaggctggaaagaatgcatgctggtggcctaatgccagggctgttgaaacaatttcagatatagcactgtggtctccactttatttctttatatgttttggccgctgcattttgattgcagctaaaagagataacagaaaggagatactggctggctgcttcatattagccctctctgttgtcaacaccttgatgaggccaacccagagatgcttgatcagtcctcagctttgcagggctaggtacagaattttatcacaggattttatcacgctctctggggtgactagatccacaggaaccaaaacgcagtttccaaaagctcgagtgactgaaggatctatacacaaacatggctatttgctagttaacaacaggatatttctctctggccagatcacagacatggttctgagtcagatcttccttggtggcatccctttaaagaggccatcttatgaacaggatcacaagtgagcttagtgagcagagagttagaacaaatctagctaggtgtgtttaaggaatatttccattcagctagtgtagctggattaatttctattctccaaatcaaggatgtctagaaaatgggcattgtggctttcaaatctaagaagaatctcctttgggccagctggatgtacaataaaaatgcttgtttcttggccttccttt

SEQ ID NO: 7041 - DNA, 1201 bp, Homo sapiens
ggcagaggaacagttggccaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgtttcggtggtgctgaatgttacttttcctcctctcctaagtggaaacgacttccaaacagttgaggaaggcagtaatgtgaagttggtttgcaatgtgaaagccaacccccaggctcaaatgatgtggtacaaaaacagtagtctcctcgatttagagaaaagccgtcaccaaatccaacagacaagtgagtcttttcagctgtcaatcaccaaagtcgagaagcctgacaacggaacctacagttgtattgcaaagtcatctctgaaaacggagagcttggactttcacctgattgttaaagataaaactgtgggtgtaccaatagagcccattattgctgcatgtgttgtgatctttctgacattgtgctttggactgattgctagaagaaagaaaataatgaagctctgcatgaaggataaagaccctcacagtgaaacagctctatgagaaagctgagatgccatcgaatacagagagagttttgcatcaggacctccacaatttatgtagtcccatctgtatttattgctattattaaattcactcctgtcactcctgtttcattaatcacttaacagtagttgttaggactaatttgatacacttgtggaacatttttatggaaagagctattaagaatgaaaagtaagattttgttaagtcttctccttgaagtatatgttaattaattgagatttgttccaaataggttggtaatcatttactgtttagtgtgttttttttctaggtaggagatacttgggtctcacaaattggtgcaaagcc

SEQ ID NO: 7042 - DNA, 727 bp, Homo sapiens
ggcagaggaacagttggccaaggaagtcagcttctcagagctcaagagtagatctgagtttaactcattaaagatggcatggaagagcagtgtcataatgcaaatgggaagatttcttctcttagtaattttatttctgccacgtgagatgacaagttctgttttaactgtgaatggtaaaactgagaactatatcctggatactacacctggctcccaagcatctctgatatgtgctgttcaaaaccacaccagagaggaagaactgctctggtaccgagaggaggggagagtggatttgaaatctggaaacaaaatcaattccagctctgtctgtgtctcttccatcagtgaaaatgacaacggaatcagctttacctgcaggctggggagggatcagtccgtgtccgtttcggtggtgctgaatgttacttttcctcctctcctaagtggaaacgacttccaaacagttgaggaaggcagtaatgtgaagttggtttgcaatgtgaaagccaacccccaggctcaaatgatgtggtacaaaaacagtagtctcctcgatttagagaaaagccgtcaccaaatccaacagacaagtgagtcttttcagctgtcaatcaccaaagtcgagaagcctgacaacggaacctacagttgtattgcaaagtcatctctgaaaacggagagcttggactttcacctgattgttaaagctttacaacaaggc

SEQ ID NO: 7043 - DNA, 1254 bp, Homo sapiens
ggaagtctgtcaactgggagggggagaggggggtgatgggccaggaatggggtccccgggcatggtgctgggcctcctggtgcagatctgggccctgcaagaagcctcaagcctgagcgtgcagcaggggcccaacttgctgcaggtgaggcagggcagtcaggcgaccctggtctgccaggtggaccaggccacagcctgggaacggctccgtgttaagtggacaaaggatggggccatcctgtgtcaaccgtacatcaccaacggcagcctcagcctgggggtctgcgggccccagggacggctctcctggcaggcacccagccatctcaccctgcagctggaccctgtgagcctcaaccacagcggggcgtacgtgtgctgggcggccgtagagattcctgagttggaggaggctgagggcaacataacaaggctctttgtggacccagatgaccccacacagaacagaaaccggatcgcaagcttcccaggattcctcttcgtgctgctgggggtgggaagcatgggtgtggctgcgatcgtgtggggtgcctggttctggggccgccgcagctgccagcaaagggactcaggtaacagcccaggaaatgcattctacagcaacgtcctataccggccccggggggccccaaagaagagtgaggactgctctggagaggggaaggaccagaggggccagagcatttattcaacctccttcccgcaaccggccccccgccagccgcacctggcgtcaagaccctgccccagcccgagaccctgccccagccccaggcccggccaccccgtctctatggtcagggtctctcctagaccaagccccacccagcagccgaggccaaaagggttccccaaagtgggagaggagtgagagatcccaggagacctcaacaggaccccacccataggtacacacaaaaaaggggggatcgaggccagacacggtggctcacgcctgtaatcccagcagtttgggaagccgaggcgggtggaacacttgaggtcaggggtttgagaccagcctggcttgaacctgggaggcggaggttgcagtgagccgagattgcgccactgcactccagcctgggcgacagagtgagactccgtctcaaaaaaaacaaaaagcaggaggattgggagcctgtcagccccatcctgagaccccgtcctcatttctgtaatgatggatctcgctcccactttcccccaagaacctaataaaggcttgtg

SEQ ID NO: 7044 - DNA, 8805 bp, Homo sapiens
agatagaaaaagtagtttgcttggcatctcccaaattatcttgagcaaacaataaaataagaaatgtttcagaagacaattcggctcccaggcccaaaccaaaactcgaacctggtactttttgtaagtgcgggccaagaaaggggctgtaaagttaaagagccggtggcgcctctgaacacacccgggcagggcgagcaggatgtccttgtccagggagaccccttctcctggctttgaggaaggtgctccctatccccgcgggttcctccgccaagcgggacgccgcgccgggcgggtgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatatgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataa

SEQ ID NO: 7045 - DNA, 2199 bp, Homo sapiens
agatagaaaaagtagtttgcttggcatctcccaaattatcttgagcaaacaataaaataagaaatgtttcagaagacaattcggctcccaggcccaaaccaaaactcgaacctggtactttttgtaagtgcgggccaagaaaggggctgtaaagttaaagagccggtggcgcctctgaacacacccgggcagggcgagcaggatgtccttgtccagggagaccccttctcctggctttgaggaaggtgctccctatccccgcgggttcctccgccaagcgggacgccgcgccgggcgggtgagagaaagcccgggcaggagagcacagagccggcgactggacgcgagcgcggggcgggtggagagcgtctctccgggcgccgctgctgttgtcccgggtgctgaaaagccgggaacttcccgggaagcagcggcacttttctccctggaaggctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggtaattgtttcacacagtagtttttttcaatgttattgttacatgtataaattaatgttacacagatttttgtactaa

SEQ ID NO: 7046 - DNA, 2758 bp, Homo sapiens
gtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggg

SEQ ID NO: 7047 - DNA, 7960 bp, Homo sapiens
gtgacagagcgagactccgtctccaaaaaaaaaaaaaaaaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatatgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcaatctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcctattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataagtatgtctggtttcaa

SEQ ID NO: 7048 - DNA, 4228 bp, Homo sapiens
gcgcggggagctcgcggcgggtccagctgccgcagcaccatgcccgagcccccctccgggcagacgccgcgcgccgccggggccccggtaggggaggatgccagacgcccgggagaggccagggcagcagcggcggcggcggcgcgatggtggtgaccacctctgcccgaggcggcggcggggaccgcacaccctcccggcggcggggctgcgggctagcgccggccggggccgcggcgctgctggccggggcaagctgcctgtgctacggccgctccctgcagggcgagttcgtgcacgacgacgtgtgggcgatcgtgaacaaccccgacgtgcggcccggcgccccgctccgctggggcatcttcaccaacgacttctggggcaagggcatggccgagaacaccagccacaagtcctaccggccgctctgcgtcctcaccttcaagctaaacatatttttgactggtatgaacccattctactttcatgcagtaaatataattttacactgcttagtgactcttgtgctgatgtacacctgtgataaaactgtcttcaagaatcgtggacttgcttttgtaacggcattgctttttgctgtacatcctattcatactgaggcggtggctgggatcgttggcagagcggacgtgttagcgtgtctgctgtttctattggcctttctctcgtacaacaggagtctggatcagggctgtgttgggggaagtttcccttccacggtgtctcccttcttcttgctgctcagtttgtttctggggacctgtgcgatgctggtgaaagagacaggcatcacggtgtttggagtgtgcttggtttatgacctcttttccctttccaacaagcaagacaagtcgagcaatggggccctctgtccacgcagcccacagcagcccgggagcccccagccctcctcactgccaggccatcctcaccgggagaatgggaagcagcagcggttccctcacaaaggagcttggggtggctgccactctccactgccaccagaacccaagagcagtggattcccagtgtccccacgagctgtgtggtccatgatgaggtatctgagagcaagcagcaatagaaatttcctgcttaccatgagaccatttttaaaaagggccattttggtcctaagttatgtgcttgtcattttgtacttccgtctgtggataatgggaggatctatgcccctcttttcagagcaggataatccagcttcattttcgccttacattcttacgagattcctcacctattcctacctcttggccttcaatgtgtggcttctgcttgcacccgtgaccctgtgctatgactggcaggtcggcagtattcctctggtagagaccatatgggacatgcggaacttagccaccatctttctggcggttgtgatggccttattgagcctgcactgcttagcagcctttaagagactggagcacaaggaggttttagtcggcttgttgttcctggtgttcccgttcattccagccagcaacctcttcttcagggtgggttttgtggtggcggagagagtcctttacatgcctagcatgggctactgcatcctttttgtgcatggactgagcaagctctgcacttggctgaatcgatgtggggccaccaccctgattgtgtccactgtgttgctgctgttgcttttctcttggaaaactgtgaaacagaatgaaatttggctgtcaagagagtccctattcaggtctggagttcaaactctgccccacaatgccaaggttcactacaactatgccaatttcctgaaggaccaaggtcggaacaaggaagcgatctaccactacagaacagctctcaagttgtatccacgccatgcaagtgcgctcaacaaccttggaacactgacgagagacacagcagaggcaaagatgtactatcagagggctctccagctccatccacagcataaccgggctcttttcaatctggggaatctcctcaagtcccaggagaaaaaggaagaagctatcaccttactgaaggattccatcaaatatggtccagagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtggtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatata

SEQ ID NO: 7049 - DNA, 5681 bp, Homo sapiens
gtcacgcaggcgcggggggccgcgtcgagaaccccacgcgggagcttctggagtctccagccaccgcttctcacttcactggagaagggagctggggctggggctggggctggggctgggagggagctaataaacattgaatgtgcagcagctgccttggcggccggagtccgcccgagcgacaccggagcagtgcgcccgggaggcggcgaggggaggcggttcgccttgtccctcccacccgcgcctctttctctctcttcctccagctggtcccagagcccggcttggtccggtccctctgcccccatcccgcacccttccacctcctccgagtcccactcctcacctaggacgccccaaactgccatgggttagggtggggatcgcgacccgcgcgaaagaccagccctgcgcttccgccgggggacgcggagcccaaacgccgctcaccgcttgcgggcgccgggcatggggagtgtggtgtgagcccgcacccggggaggacgcaggagctgcggagacgggcgcgaggaggaggagaggagtcgtggattggaaggacccgagggagggagggtggggaagcgagggaaaagtgaagctgggaggagaaggcggcggaaggtggagattgatgcttctgttttttgttgccgctgctgccctcgcgctgggagccgagccggagggaaggcggtggagagatgattgcagagttggtgagcagcgctctggggctcgccttgtatctcaacaccctgagtgcggatttctgctatgatgacagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaaaggaagaacttgtcgcttttcctaagcattagtttgttaattttctggggttcctcccttttgggtgcccggttatactggatgggaaacaaaccaccaagcttttccaactcggacaaccccgctgctgattcggacagcctcctcacccgcactctcaccttcttctacttgccaaccaagaacctctggctgttgctatgtccagataccctcagttttgattggtcaatggatgctgtgcctctgctcaaaacagtttgtgactggagaaacctacacactgtggccttctatactggactccttctccttgcctactatggtttgaagagcccgagcgtagacagagaatgcaatgggaaaactgtaacaaatggcaagcagaatgcaaatggacatagctgcctttcagatgtggagtaccagaactcagagactaagtccagctttgcatccaaagtagaaaatggcattaaaaacgatgtatcacagagaacccagcttccttctacggagaacattgttgttctgtctttatctttgttaatcataccctttgttcctgccacgaacctgtttttctatgtcggctttgtaattgcagagcgagtattatatattcctagtatgggcttctgcctactgattacagtgggtgctagagccctttatgtcaaagtccaaaagcggttcctcaagagcttgattttttatgctacagctacactaattgttttttatggactcaagactgcgatcaggaatggagactggcagaatgaggaaatgctttatagatcagggataaaagtaaacccagctaaagcatggggtaaccttggaaatgttctgaagagtcagagcaaaatttctgaagctgaaagcgcctatagaaatgctttgtactaccgcagcaacatggctgacatgctttataatttagggctacttctccaggagaacagcaggtttgcagaagcactacattattataaattggccattgggagcaggcctaccctggcttctgcatatttaaataccggtattattctaatgaaccaaggaaggacggaagaagcccgacggacattcttaaagtgttcggagatcccagatgaaaacctaaaggaccctcatgcacacaagagctctgttaccagttgtttgtacaacctaggaaagctgtatcatgagcagggacactatgaggaagcccttagtgtatacaaggaagcaattcagaaaatgccaaggcagtttgccccacagagcttgtacaacatgatgggtgaagcatatatgcgtttaagcaaactccccgaagcagagcattggtatatggaatcactgagatccaagactgaccacatccctgctcatctcacctatgggaagctgctagctctaacaggtcgtaagagtgaggctgaaaagctcttcttgaaggctattgagctggatcccaccaaaggaaactgttacatgcattatggtcagtttcttctggaagaagctcgtctcatagaagcagctgagatggcaaaaaaagcagctgaactagacagcacagagtttgatgttgtcttcaatgctgcccacatgctcagacaggctagcctcaatgaagcagctgagaagtattatgatctggcagccaggctgaggcctaattatccggctgctttgatgaacctgggagccattctgcacctcaatggcagactccagaaggccgaggccaactacctgcgggccctgcagctcaagccagacgatgtcatcacacagtccaatctccgcaaactgtggaacatcatggaaaaacaaggcttaaagacttctaagacctgacacaggaggcagaagcccatcctcctccatttttaaaagctggcttccttagcagacagaacttcccagcagtgctatgacaagagctggtgttagacttcaagaccagggcagaggtcattgaggtcactaccgcttctggaagaatccactttgctgtaggcacagctgttaacaccaaaaaggggaaagccggaaacctcctggaggatgtcattgttacccatagactgtaaaccagagcacttaaaacagaaccttttggcattcttaaaaagggaggggtgggtgtgtaagtcacagattttgttcattttctgaaagctaatttcaaaattatgttgttccttaaacactgtgagaggaagtcagagtgtccattcaggcatggcaaacaattagggttaagtgttacgagggagtgataaacacgtagtgtgagtcccagtgagccgccggttgtcctaacgctgctgtcttccctgtttgggacagcctgcttatcaatttctgaagcttagaacactttttttaatactgtgtcaagatctgtcagaatctgctatgtttcttgaccagtgcacataatgttttatgatttggatgtcagaggcttcattcttttggacatcatttgctttttatgttctgaaaaggatatggagagtagagctaaccatacttcacactcgagttgtatgagggactggggaggccttatatgtgtcaggcaggcattttttaaattttaatatcgtcaatattttcccccaaactgcccagtagaattcattgtattaattcttttgaaattacctttgaaaatagctattcctggagaatgtgcaagcttacataaggataaaggacaggggaggagtttgtaagccttgcagttccaataactaaccaacaggttattagacaaaagggaaggtgttttgtgcttctcagatgttgctggtttaggagtgtgtgatgatgcttgccagtgattttgtgttttggaaagggtaggtatcgaatgttaatcactttctaatgggtacctaaacagcaatgctgataaatgttcaaggaattattttcatcttagtttgttcttctcaaaaggcatcaaaaacaacttatttgaagctgcaatagagtgtagcattagcctgcatgtttctaggtcttctgccaagtgcttttctcagttgaaaactatttttcactagcaaaattggtattttatttcattacctgttagtaactacttcaatgatcatttcacaagaaaaagactataaattaagtagagaacaacatttttattgaacatttttggcttgcaatcaaactttgccactaaaaattaacttcataaaacactagtccgttatcaacttcttcacagagaaagtagctatactataccctacatatttatttatttattattctactatagcagaataacaaaacttgatgcattaagccagttctttgcaactgaaaattacctgtttctccttccctttcacactccatgtatatatgatcagcctctccattaaaaagaagctggacatgcaaatacatcatattatgttttctccatattttatgtttttctatgtatctgaatacagtgggataaataattgaaagtagtgttcctatggcattagtgtttttgtgagaagggtaaatgtagtgagaaaggttttttcatggcattaataagaaagcccttctgtaatatatatattattttgtaaacatttcactgaagggccaaaagttaaattataactaaatcactgtgttttcagaatgatatttaacaacaaacccgtggtcaaaccaaaatagtgggttgaagtgtattattcatcttttagtgcattggcaattgcaaaaaaaaaaaaggaatttaatataaggctatagagattaattcagtgtctaacatttgtatttatttaaatagttattgacctatgatgactttctagtcttaacattttatctttttattgttgttgttcttcctttcaaagatgtggttcttaataggttcactgaatgcacagttgaggcacttcttgtgacaccagttcccaagtagcgttaataattgggcctgtgtcataaaatgcacggatcattaataactaaatgtccctgacacttttcactacagggctggacttagtaactgaccaacttcggggggagggttggggcaagggggggtgggcgttagaacatgatcaaaaaatgtctccgctcagggatttatggtggattattgcagacagtgctaaaaatatagagcacaagacaagtttactaaattaaaattttattttttgagaaactgttatttgtataaattatcaagatttgtaggctttccttttgtagaaataattgttttatgtgccagagaatttcaattttgttttcaacaataaa

SEQ ID NO: 7050 - DNA, 7203 bp, Homo sapiens
atgcaacgcgtaagactgcgacggtaccggggcggcggggaaggaccgagaggcgggaggagcagcggctcaggcgcctgcaaactggtggcctgaacgaggtagaccatgactgtggtttcagtggcgtcactcgctgggctgctcttcctgaggttttcctaagccatcccctggcggaaccgcccccagtttttgtccagaagtgcttatagaaaagatggctaatattaacctaaaagaaataaccttaatagtaggtgtggttactgcctgctattggaacagcctcttttgtggttttgtttttgatgatgtttcagcaatactggataacaaagacttgcatccatctacacctttaaaaactttatttcaaaatgacttctggggaacccctatgtctgaggagagaagccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacatacagaagcagtaacaggagttgttggaagagcagaacttttgtcatctatcttttttctagcagcttttttgtcatataccagatcaaaaggaccagacaattccataatatggactccaattgccttgacagtgtttttagtggctgttgcaacattatgtaaagaacaaggaataacagttgtaggaatttgctgtgtgtatgaagtgtttattgcccaggggtatactttgccattactatgtactactgctggacagtttctccgtggaaagggtagcattccattttctatgctgcagacactagtaaaactcattgtcttgatgttcagtacattattacttgttgtgattagagtccaggttattcaatcccaacttccagtattcaccaggtttgataacccagctgctgtaagcccaactcctacaaggcaactaacttttaactacctccttcctgtgaatgcttggttgttattaaatccttcagagctctgctgtgattggaccatgggaacaataccacttatagagtcattactagatattcgaaatctggccacatttactttcttttgttttctggggatgttgggagtattcagtatcagatactctggtgattcctccaagactgttttaatggcgctttgtttaatggcattaccatttattcctgcatcgaaccttttttttccagttggatttgttgttgccgagcgagtattatatgttcccagcatggggttctgtattttggtagcccatggatggcagaaaatatcaacaaaaagtgtatttaaaaagctatcctggatttgtctgtctatggtgatactcactcattccttaaaaacattccacagaaattgggattgggagtctgaatatacattgtttatgtcagccttgaaggtaaataaaaataatgccaaactttggaataatgtgggtcatgctctggaaaatgaaaagaactttgagagagctttgaaatacttcttacaggctacccatgttcagccagatgatattggtgcccatatgaatgtaggaagaacttataaaaatttaaatagaaccaaagaagctgaagaatcttacatgatggctaaatcactgatgcctcaaattattcctggtaaaaaatatgcagccagaattgcccctaaccacctaaatgtttatatcaatctggctaacctgatccgagcaaatgagtcccgactggaagaagcagatcagctgtaccgtcaagcaataagcatgaggcccgacttcaagcaggcttacattagcagaggagaattgcttttaaaaatgaataaacctcttaaagcaaaggaagcatatcttaaagcactagagctggacagaaataatgcagatctttggtacaacttggcaattgtacatattgaacttaaagaaccaaatgaagccctaaaaaactttaatcgtgctctggaactaaatccaaagcataaactagcattattcaactctgctatagtaatgcaagaatcaggtgaggttaaactcagacctgaagctagaaaacgacttctaagttatataaatgaagagccactagatgctaatgggtatttcaatttgggaatgcttgccatggatgacaaaaaggacaatgaagcagagatttggatgaagaaagccataaagttacaagccgacttccgaagtgctttgtttaatctggctctcctgtattcccagactgcaaaggaattaaaggctttgccaattttggaggagttactcagatactaccctgatcatatcaagggcctcattttaaaaggagacattctgatgaatcaaaagaaagatatactaggagcaaaaaaatgttttgaaaggattttggagatggatccaagcaatgtgcaaggaaaacacaatctttgtgttgtttattttgaagaaaaagacttattaaaagctgaaagatgccttcttgaaacactggcattagcaccacatgaagaatatattcagcgccatttgaatatagtcagggataagatttcctcatctagttttatagagccaatattcccaaccagtaagatttcaagtgtggaaggaaagaaaattccaactgaaagtgtaaaagaaattagaggtgaatccagacaaacacaaatagtaaaaacaagtgataataaaagtcagtctaaatccaacaaacaattaggaaaaaatggagacgaagagacaccccacaaaacaacaaaagacatcaaagaaattgagaagaaaagagttgctgctttaaaaagactagaagagattgaacgtattttaaatggtgaataacattaatatttatcgtgacaatggtatcaaagaacatcaatccgtatcatgtgattgcttttactgggagctttgaaaaaaagttcaagggttcctaatggtcaatcatgagctgccttgaagtaggatcaaaataagattttcattaaagacctgtattatcccaggatgtatattatgtatcgctgttttcagagtgtgggtgaatatagcagaaatattacagcggaagtgacaaatttacaacttttattatagaaagaaggtgtttctggcaatgtaatctttactgctctcaattaaaaataattttgaggcctgaatgataatcccttgaggacaaatccaacatgtgctggtttattctgttaattcccatttatttgcctacttcatttttcttgcacctcttagaatctaactatgaattgaaaacacttaagtaattctgtttaatcaagggatttacactacaaaagaatgctggctttttttatgttgtattccttagttgagttttagaaggaatgcttgatgaaacattttaaaataagtcatgacatgttagcttgagaatgtattttcataattgtatacttgtttttaactttaaatgtaatttttaatcaggtaaagtttgacacatgtatagctacatacacacatttttaatggtgctcatatatactgtattttttgttgtttagttttacttattgagagtgtcacaacatgaatcacataatcatgattttttttttttacttttactccccaaattattcatgtttcttagatcgtagtcattgagaagtcccaataactctaaacttttgagttataacgtagtaaacttctctttcatctttgtgttagctctgtagtcttaacctggattttaatttttttgtttccaaagtcacaattgaattattcttagataccttaagccactgaattcagttctgtttgactgaaagcaaaacaacgtgacagtttattttcaaacactaacttcttgatattttgttatggtatatctttttattaaatatttattttgactaagctttcataaaatatttgaagctattttaatcatcaagtatggaaaacaaattactattgcattttcctatatatgcatatattatggattaaccagaattgtatcatttttggcctaatgtctggatataaaagataattagcctactatagtattaataaatttttcagttggtttgggcaaatttaaacctgaaaaataggttaaaaagtagttacaaattaaacttactaatttatacctgattttttttcttgaattaaagtacattttaaatgagctttataataccttaaaaagttggttctaatttaaaatatgaaagctctggctatcatcctgggatagtaatttctaattatatagtatttcaaaactatatattttttagttcctttgagataactaatttctaattatatatgtttcaaaaaccatatcctgtattttttttaagaattgttttataaataggtcataagatacaaggtctgcattagaagacccactcttactaggttccctaaggatctgccatagatttttttttttttttttttttttttaggtagtttaaagcaagcactgataccagtgggagttggtcttgatctaggagattctgttaagcatccaaaaacaatgcctaatttcagttcttaggttatggcttgtgactccagataaaagatggagaatacctcatgtactgtgacttgaaaatgaattcttaaaattcttaggctctctccatgtatctttcttaaggaaaagtttctgagtgtgatctctcttttgccatagtatcaagtggagggtagttcagaaaagttaataggaaatcttttgtgacagcagactataatagaagtttgagtaatattttaataaatttatataattcaaatgataaaaatgtatcaatgttatccaatgatttttattaaaaaattaccttattattagaactgtgcctattacataaaaagtgctcatgtatttgaattttaaataatttatttaaatcaagaccaccataagtcattaataatttaataattgttttaaatcagtggttttcaaccctcacttcatattagaatcatctgaggacttttaatatggaatccacctcataacaattaagtctaaatttctggaagatggagccatgcttgtttttccaaaagctctttgagtgattctaatttgtagtcagagttgaagaccactgctctaaattagtgcaggaaaatgcttttatttctcccatgttaacttttaaaactagtaatgtacccagttaagttttgatggtttaaattccactaaagaacatattcttctaataactagcatttattacatgaaatttaagagtttaagttccatcaaactagcccttgtgtaagattattatttcttctctataacttcaaaatagatatttcattcaaactgttcaggtgagaaaacataatggatttttttttttttcctctggagctgcctgttcagtgagatggaggaggtgggcacatttaaggtcagttcactaacctatggttcagagttctgatcatatggaagtttggaaaagagagcttatcacaggtttgtatgctggtgaatggatagttttaattctcactgtctcaaaagagaatcagctctccagcagttctagaaaagctttgacaatccccaaggggcagtgttaccttactccttcactgcttcttagaaggtagaattaagtttctggaattgcacctacatgttttcttattaacattcagaattgggaatattaatttttccagtgagtagttttctgaaattggtaacttggagagtaaaataacgtattttgcttttcaattttgtgtttgtttacttttatgtaaaaatttgatatgtgaattacacagttctaataaaacctcatgccttttcattacatctaatttgaactctcaacttcatgttacagaatgctttaaagatgctttaatgaaaagtattaagaaaatatatagatttgtatgtcagtttatacttcagaaatccatatatttgtcatatttatttttttagaaacctcctaattggataactagatggtatttaaaatgaatgcccaaaaatatcttgtacctttgtccaaaagtttatctgttggaagccgccagccattcatgtagagagtttataagaaaataatttaaaattgtatgcattttatattactatggtatctgtgtaccatatttctaagtattcattattaaattggtacttcttaaaaccataacctggcttgccttttagtgttaaaaaaatacaacattgtatatagagatttcttttatgaagaagagctgacgtaatttattagcagtgatctgagaaagacattaaataagtttctgagagtgatacattttcaaacatgaggagtgacaaccaccaaattaagaaaaggaaacaactcagacttggaattttatacgaatttcatttctatatgtgcctggtattgcctctggcataacttagaggaaattgttctacctatatgtcctcagtttcttcatctacaagttgggaaaaacattttcctcttaaaattgtgaagaggatttatatatttatatgatatattgtatatattaatatatttaaattgcttagagtttctagcacatagcaaataataaatattagttattagtataaacataaggcttaaagtcttggatttgatgcatatgacttaatttgtatttgtgctagtagctgtaatgtcagtgacaggataacaagcaaatgattagaaatctaatagtaatgcttgttcctttgctatctatgctaacaagtacatagatagcctaagataaattatacttaggatgaagctaaaatgcataactgagacaccttaaaattgtactaccttgtgctgttcactgccatcagggaggtagcataaaatgaaagataaagtctgaagactggatccaggcaaattcatgttctttctttgtaactcactttcttcgtcaacatttctgtgactcaatggatagcatatttccatcaagtagcacgtataacgtgatgctttcatgtttctgccttaaataaaataaccctcaaaaaacca

SEQ ID NO: 7051 - DNA, 574 bp, Homo sapiens
atgcaacgcgtaagactgcgacggtaccggggcggcggggaaggaccgagaggcgggaggagcagcggctcaggcgcctgcaaactggtggcctgaacgagtttttgtccagaagtgcttatagaaaagatggctaatattaacctaaaagaaataaccttaatagtaggtgtggttactgcctgctattggaacagcctcttttgtggttttgtttttgatgatgtttcagcaatactggataacaaagacttgcatccatctacacctttaaaaactttatttcaaaatgacttctggggaacccctatgtctgaggagagaagccacaagtcttaccgtcccttaacagtattgacatttcgcttaaattatttgttaagtgaactaaaaccaatgtcatatcatctcctgaatatgatttttcatgctgtggttagtgtgatatttctcaaagtatgcaaactttttctggacaacaagagtagtgtgattgcttctttactttttgcagtgcacccaatacatacagaagcagtaacaggagttgttggaagagcagaacttttgtcat

SEQ ID NO: 7052 - DNA, 2101 bp, Homo sapiens
gagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatg

SEQ ID NO: 7053 - DNA, 3602 bp, Homo sapiens
agagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagc

SEQ ID NO: 7054 - DNA, 3483 bp, Homo sapiens
gcgggaggcgcggcgcggggggggtcgggtgcgcggcgggcggcccctccccctgccaggtccgggcgggtgcctggagccgccagagtttccgcacccgggagggagatgcggccggggctcaggctccttgcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataaggacctccaagcagaaacgcccctgggggacctgtggcatcatgacttctggggcagtagactgagcagcaacaccagccacaagtcctaccggcctctcaccgtcctgactttcaggattaactactacctctcgggaggcttccaccccgtgggctttcacgtggtcaacatcctcctgcacagtggcatctctgtcctcatggtggacgtcttctcggttctgtttggcggcctgcagtacaccagtaaaggccggaggctgcacctcgcccccagggcgtccctgctggccgcgctgctgtttgctgtccatcctgtgcacaccgagtgtgttgctggtgttgtcggccgtgcagacctcctgtgtgccctgttcttcttgttatctttccttggctactgtaaagcatttagagaaagtaacaaggagggagcgcattcttccaccttctgggtgctgctgagtatctttctgggagcagtggccatgctgtgcaaagagcaagggatcactgtgctgggtttaaatgcggtatttgacatcttggtgataggcaaattcaatgttctggaaattgtccagaaggtactacataaggacaagtcattagagaatctcggcatgctcaggaacgggggcctcctcttcagaatgaccctgctcacctctggaggggctgggatgctctacgtgcgctggaggatcatgggcacgggcccgccggccttcaccgaggtggacaacccggcctcctttgctgacagcatgctggtgagggccgtaaactacaattactactattcattgaatgcctggctgctgctgtgtccctggtggctgtgttttgattggtcaatgggctgcatccccctcattaagtccatcagcgactggagggtaattgcacttgcagcactctggttctgcctaattggcctgatatgccaagccctgtgctctgaagacggccacaagagaaggatccttactctgggcctgggatttctcgttatcccatttctccccgcgagtaacctgttcttccgagtgggcttcgtggtcgcagagcgtgtcctctacctccccagcgttgggtactgtgtgctgctgacttttggattcggagccctgagcaaacataccaagaaaaagaaactcattgccgctgtcgtgctgggaatcttattcatcaacacgctgagatgtgtgctgcgcagcggcgagtggcggagtgaggaacagcttttcagaagtgctctgtctgtgtgtcccctcaatgctaaggttcactacaacattggcaaaaacctggctgataaaggcaaccagacagctgccatcagatactaccgggaagctgtaagattaaatcccaagtatgttcatgccatgaataatcttggaaatatcttaaaagaaaggaatgagctacaggaagctgaggagctgctgtctttggctgttcaaatacagccagactttgccgctgcgtggatgaatctaggcatagtgcagaatagcctgaaacggtttgaagcagcagagcaaagttaccggacagcaattaaacacagaaggaaatacccagactgttactacaacctcgggcgtctgtatgcagatctcaatcgccacgtggatgccttgaatgcgtggagaaatgccaccgtgctgaaaccagagcacagcctggcctggaacaacatgattatactcctcgacaatacaggtaatttagcccaagctgaagcagttggaagagaggcactggaattaatacctaatgatcactctctcatgttctcgttggcaaacgtgctggggaaatcccagaaatacaaggaatctgaagctttattcctcaaggcaattaaagcaaatccaaatgctgcaagttaccatggtaatttggctgtgctttatcatcgttggggacatctagacttggccaagaaacactatgaaatctccttgcagcttgaccccacggcatcaggaactaaggagaattacggtctgctgagaagaaagctagaactaatgcaaaagaaagctgtctgatcctgtttccttcatgttttgagtttgagtgtgtgtgtgcatgaggcatatcattaatagtatgtggttacatttaaccatttaaaagtcttagacatgttattttactgatttttttctatgaaaacaaagacatgcaaaaagattatagcaccagcaatatactcttgaatgcgtgatatgatttttcattgaaattgtattttttcagacaactcaaatgtaattctaaaattccaaaaatgtcttttttaattaaacagaaaaagagaaaaaattatcttgagcaacttttagtagaattgagcttacatttgggatctgagccttgtcgtgtatggactagcactattaaacttcaattatgaccaagaaaggatacactggcccctacaatttgtataaatattgaacatgtctatatattagcatttttatttaatgacaaagcaaattaagtttttttatctcttttttttaaaacaacatactgtgaactttgtaaggaaatatttatttgtatttttatgttttgaatagggcaaataatcgaatgaggaatggaagttttaacatagtatatctatatgcttttccccataggaagaaattgactcttgcagtttttggatgctctgacttgtgcaatttcaatacacaggagattatgtaatgtaatattttacataagcggttactatcaattgaaagttcaagccatgctttaggcaagagcaggcagcctcacatctttatttttgttacatccaaggtgaagagggcaacacatctgtgtaagctgctttttagtgtgtttatctgaaggccgttttccattttgcttaatgtaactacagacattatccagaaaatgcaaaattttctatcaaatggagccacattcggggaattcgtggtatttttaagaattgagttgttcctgctgttttttatttgatccaaacaatgttttgttttgttcttctctgtatgctgttgacctaatgatttatgcaatctctgtaatttcttatgcagtaaaattactacacaaactagcatgaaaa

SEQ ID NO: 7055 - DNA, 639 bp, Homo sapiens
gcgggaggcgcggcgcggggggggtcgggtgcgcggcgggcggcccctccccctgccaggtccgggcgggtgcctggagccgccagagtttccgcacccgggagggagatgcggccggggctcaggctccttgcagttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatggtgtgtcccgttgcctgttggatctgtctccatcttcactcagacagaaggctatagaaagatgcctgtgacttcagattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataag

SEQ ID NO: 7056 - DNA, 580 bp, Homo sapiens
aacccggcttcctcctctcccgccgggtccgtctgtccctgcgcctccttcgccgccgactagcgccccctggcctgacgtcaccggcgcgtccgccaatgagctgaggagggacttggctgtggcctgaaagtgacgggagcagcagccaatgttgtaatttagattcgagaagtggtttatcctttgactggaaaagaaaagtagctgcagtattcccccagcacttgctgagagcatgccgtatgccaggctgtgaggctcgagagacaagcagtggaagagttgcggcctgtttcatctctggattgtaaatctgagcctccttctggcccctggaaggggacagcatcaccatggaatgattcctaaccagcataatgctggagccgggagccaccaacctgcagttttcagaatggccgtgttggacactgatttggatcacattcttccatcttctgttcttcctccattctgggctaagttagtagtgggatcggttgccattgtgtgttttgcacgcagctatgatggagactttgtctttgatgactcagaagctattgttaacaataag

SEQ ID NO: 7057 - DNA, 1353 bp, Homo sapiens
aatgccccgggccgcggcggcggggaaggaggggtgcttcaggtgcctgcgacctccgcgcctcccgcccggaagtgcccgaggggccgcgatggagctgggggagccgggcgctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcactctt

SEQ ID NO: 7058 - DNA, 1563 bp, Homo sapiens
gtgccgcgggtggggtttaggtgaaccgtaacgcggggggcgggggtgggggcacagaggctctacccccacctcttagaaactttagcagcggagtagatgagcctggggtgaagtcggtgaaggagtagacacactggggtgaagtgggcaggagaatagatacgcttgggggtgaagtttggttggggtgaagtttaggagaggcgttgcttaggcccttaccttgggatagggtttgggtgagttgggagctggttgaagacctcgagctcagatgacagaaagttaggacttgggattcggcgatgggaaggggcacccggagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttca

SEQ ID NO: 7059 - DNA, 1549 bp, Homo sapiens
ggttggggtgaagtttaggagaggcgttgcttaggcccttaccttgggatagggtttgggtgagttgggagctggttgaagacctcgagctcagatgacagaaagttaggacttgggattcggcgatgggaaggggcacccggaggcaagtttggggcgactgggaggcagagaagccggtaccctggggtgggtgaggggacggaggctgaggacggtgggagcgtcgcggtggggtgagggcaggaccctgtggaggttccagggctcctggccagggggcccgggcctcacgggctctttgtgcctctccagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttc

SEQ ID NO: 7060 - DNA, 882 bp, Homo sapiens
gcgcggagttagtcctccgcggagtggggttgaggggacctggagggggccgagctggctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccg

SEQ ID NO: 7061 - DNA, 899 bp, Homo sapiens
ccgcccagggccccggtcgggccgggatcgccgtgccctcctgcggcttcggggggcgggaagctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgtgtccacgagagtcggtcccccaaatcccccctgcccgccggggtccgagcccggcccctccgggctggaaatcggcagcctgctgctgcccctgctgctcctgctgttgctgctgctctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcggg

SEQ ID NO: 7062 - DNA, 584 bp, Homo sapiens
gtttgctgtgggggaagcctgggaagcagtcctgtgccgcggctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgacacccagaccctgggcagccttcacctccctcccaactgcgttctccactgccacgt

SEQ ID NO: 7063 - DNA, 550 bp, Homo sapiens
gtgaagtcggtgaaggagtagacacactggggtgaagtgggcaggagaatagatacgcttggggctcggtagcgcggcgggcaaggcaggcgccatgaccctgattgaaggggtgggtgatgaggtgaccgtccttttctcggtgcttgcctgccttctggtgctggcccttgcctgggtctcaacgcacaccgctgagggcggggacccactgccccagccgtcagggaccccaacgccatcccagcccagcgcagccatggcagctaccgacagcatgagaggggaggccccaggggcagagacccccagcctgagacacagaggtcaagctgcacagccagagcccagcacggggttcacagcaacaccgccagccccggactccccgcaggagcccctcgtgctacggctgaaattcctcaatgattcagagcaggtggccagggcctggccccacgacaccattggctccttgaaaaggacccagtttcccggccgggaacagcaggtgcgactcatctaccaagggcagctgctaggcgacgac

SEQ ID NO: 7064 - DNA, 2422 bp, Homo sapiens
cccgccccgaagtttgaggggtgtggacggtttgtgacccccttagccgaccctactcctcactggccgggacaactggtcttatcacggaggctggggccaggcagcccttcggttcgggtgggcccatggaccccagtccaacgccgagggaataggaccatccaaaagcggaaccttcgcctcagaaaaagggtgcgggacccctcctcaccgtgcggtcacggtacggacagggtagatcacaggctgagggacagagcaaagacccctgaggccggacacctggggtcctgccgggcccctccccacgagagttccctgtgtctgtgccaatcgttttcgtctttctttgccgcagtttcttttcctgtaaatcatggttaataacattaaccttcttaccatcaggggttagttgtggttgtgataaataattactaccgttattaagcaattgcaatttgcagtgtgccaggcactgtgccaagtattttgcttcgatgatttcacgtcatcttcaaaacaacctcatgagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgc

SEQ ID NO: 7065 - DNA, 1921 bp, Homo sapiens
gaagccggaagagaccggaccctgaacagaatcgcagattgccagcccttttcccgacccctacggaaagacgagtccaggggccgtcctggcgaggtcaaaacatttagtctggtcttttcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgc

SEQ ID NO: 7066 - DNA, 1582 bp, Homo sapiens
gtataacagcttccgggagaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagataattctttgagcaactactggggcattatattggacacttcagtaccaagagaaatacatacgatccttgtctaccaggagtctaatagaaagatggacagggctgggtcagttagaacctaaacaaactagagacctggttgcaacccctcaggctctgctgatgctgtccccctttgttcctgcagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcaccca

SEQ ID NO: 7067 - DNA, 1961 bp, Homo sapiens
gaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagcgtggaccctgccagcagccaggccatggagctctctgatgtcaccctcattgagggtgtgggtaatgaggtgatggtggtggcaggtgtggtggtgctgattctagccttggtcctagcttggctctctacctacgtagcagacagcggtagcaaccagctcctgggcgctattgtgtcagcaggcgacacatccgtcctccacctggggcatgtggaccacctggtggcaggccaaggcaaccccgagccaactgaactcccccatccatcagagggtaatgatgagaaggctgaagaggcgggtgaaggtcggggagactccactggggaggctggagctgggggtggtgttgagcccagccttgagcatctccttgacatccaaggcctgcccaaaagacaagcaggtgcaggcagcagcagtccagaggcccccctgagatctgaggatagcacctgcctccctcccagccctggcctcatcactgtgcggctcaaattcctcaatgataccgaggagctggctgtggctaggccagaggataccgtgggtgccctgaagagcaaatacttccctggacaagaaagccagatgaaactgatctaccagggccgcctgctacaagacccagcccgcacactgcgttctctgaacattaccgacaactgtgtgattcactgccaccgctcacccccagggtcagctgttccaggcccctcagcctccttggccccctcggccactgagccacccagccttggtgtcaatgtgggcagcctcatggtgcctgtctttgtggtgctgttgggtgtggtctggtacttccgaatcaattaccgccaattcttcacagcacctgccactgtctccctggtgggagtcaccgtcttcttcagcttcctagtatttgggatgtatggacgataaggacataggaagaaaatgaaaggcatggtctttctcctttacggcctccccacttttcctggccagagctgggcccaagggccggggagggaggggtggaaaggatgtgatggaaatctcctccataggacacaggaggcaagtatgcggcctccccttctcatccacaggagtacagatgtccctcccgtgcgagcacaactcaggtagaaatgaggatgtcatcttccttcacttttagggtcctctgaaggagttcaaagctgctggccaagctcagtggggagcctgggctctgagattccctcccacctgtggttctgactcttcccagtgtcctgcatgtctgcccccagcacccagggctgcctgcaagggcagctcagcatggccccagcacaactccgtagggagcctggagtatccttccatttctcagccaaatactcatcttttgagactgaaatcacactggcgggaatgaagattgtgccagccttctcttatgggcacctagccgccttcaccttcttcctctaccccttagcaggaatagggtgtcctcccttctttcaaagcactttgcttgcattttattttatttttttaagagtccttcatagagctcagtcaggaaggggatggggcaccaagccaagcccccagcattgggagcggccaggccacagctgctgctcccgtagtcctcaggctgtaagcaagagacagcactggcccttggccagcgtcctaccctgcccaactccaaggactgggtatggattgctgggccctaggctcttgcttctggggctattggagggtcagtgtctgtgactgaataaagttccattttgtggtcctgc

SEQ ID NO: 7068 - DNA, 2371 bp, Homo sapiens
gaggccggcgcgacggggcggggcgcggagccccagccgagcctagccctgcccggccccggaggacttgcaacactccgaggccaggaacgctccgtctggaacggcgcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagttaaaaccctg

SEQ ID NO: 7069 - DNA, 2422 bp, Homo sapiens
atgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagtt

SEQ ID NO: 7070 - DNA, 348 bp, Homo sapiens
gacttgcaacactccgaggccaggaacgctccgtctggaacggcgcagatggagtctcactctgttgcccaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggc

SEQ ID NO: 7071 - DNA, 589 bp, Homo sapiens
aagggaagttccaaacccatgacgaagaagagggctgttctggggtggagcaggaactttcttggctctggggtttccttgtctgtcaaatgaccaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatcct

SEQ ID NO: 7072 - DNA, 361 bp, Homo sapiens
tagccctgcccggccccggaggacttgcaacactccgaggccaggaacgctccgtctggaacggcgcagaggtgcaccctgaggaggtgctgggacacgtcatggtgacatcacggttggggtttctgcccacagagcctttccggccagtgcttttttttttttttcttttgagatggagtctcactctgttgcccaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccacca

SEQ ID NO: 7073 - DNA, 569 bp, Homo sapiens
gattgcttttctcctctcccatttcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgc

SEQ ID NO: 7074 - DNA, 677 bp, Homo sapiens
tttctccactgtggctcccataaacaagtccctactcctttcccccacgtgggctgatttagggataaaaggaggccaggggaggtcatttgcctggattcctgcagctagttcatgaacccaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgacccttttt

SEQ ID NO: 7075 - DNA, 581 bp, Homo sapiens
ctgcccggccccggaggacttgcaacactccgaggccaggaacgctccgtctggaacggcgcaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacgg

SEQ ID NO: 7076 - DNA, 992 bp, Homo sapiens
actccgaggccaggaacgctccgtctggaacggcgcaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaagggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttcc

SEQ ID NO: 7077 - DNA, 659 bp, Homo sapiens
ccgccccacgaggccggcgcgacggggcggggcgcggagccccagccgagcctagccctgcccggccccggaggacttgcaacactccgaggccaggaacgctccgtctggaacggcgcaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccg

SEQ ID NO: 7078 - DNA, 571 bp, Homo sapiens
aaacccatgacgaagaagagggctgttctggggtggagcaggaactttcttggctctggggtttccttgtctgtcaaatgaccaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggat

SEQ ID NO: 7079 - DNA, 526 bp, Homo sapiens
tagccctgcccggccccggaggacttgcaacactccgaggccaggaacgctccgtctggaacggcgcaggctggagtacggtggcgcgatctcagctcaccacaacctctgcctcccaggttcaagtgattctcctgcctcggcctcctgagtaactgggactacaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatct

SEQ ID NO: 7080 - DNA, 2936 bp, Homo sapiens
atccgtctctggcagggaggagggcaggctgcctggaccagtcagctgctcctttccatccctccctccagtacacatactctcctcttgctgtaaccccagtagctcaggcctcctctgcagattccggagccttaacccttcaaatacccccaggagagccccagccggggcctcagtaggcagacagcaggattaccacactgagagggctccaggggaggaggtgcttccgcctctgcatctgaaaaccttgacacccagcaagtcctgctgtctgagctcacccacttgtgccgctgctgtggtagaaagcaggggctctggttccttcctaatgggggactggggccctgagagaggagcaaacttagatctataatgggcaaggatagggcacagtctgaatgccttgataacaggcattgtgaggcaaggaagaatgttctaatcgagctgtctgcagacaaggggcttgctccatgttgctggagttccttcaagcagaaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctggacacataggccattatcctgtattcctttggcttggcatcttttagctcaggaaggtagaagagatctgtgcccatgggtctccttgcttcaatcccttcttgtttcagtgacatatgtattgtttatctgggttagggatgggggacagataacagaacgagcaaagtaacctatacaggccagcatggaacagcatctcccctgggcttgctcctggcttgtgacgctataagacagagcaggccacatgtggccatctgctccccattcttgaaagctgctggggcctccttgcaggcttctggatctctggtcagagtgaactcttgcttcctgtattcaggcagctcagagcagaaagtaaggggcagagtcatacgtgtggccaggaagtagccagggtgaagagagactcggtgcgggcagggagaatgcctgggggtccctcacctggctagggagataccgaagcctactgtggtactgaagacttctgggttctttccttctgctaacccagggagggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaatgtaataaagtttatgtctagaagtt

SEQ ID NO: 7081 - DNA, 1251 bp, Homo sapiens
gacttgcaacactccgaggccaggaacgctccgtctggaacggcgcaggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggtggggacggaggagctagggactaactgttgctcttggtgggcttggcagggactaggctgaagatgtgtcttctccccgccacctactgtatgacaccacattcttcctaacagctggggttgtgaggaatatgaaaagagcctattcgatagctagaagggaatatgaaaggtagaagtgacttcaaggtcacgaggttcccctcccacctctgtcacaggcttcttgactacgtagttggagctatttcttcccccagcaaagccagagagctttgtccccggcctcctg

SEQ ID NO: 7082 - DNA, 464 bp, Homo sapiens
ggattcctgcagctagttcatgaacccaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctat

SEQ ID NO: 7083 - DNA, 534 bp, Homo sapiens
ctagccctgcccggccccggaggacttgcaacactccgaggccaggaacgctccgtctggaacggcgcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttc

SEQ ID NO: 7084 - DNA, 561 bp, Homo sapiens
ctctagcctccacccttagacatagctacgaaagtaaacactgaccctttccccctttgctgctacctaggcagatgccagccccaaacctcatccctagtggaggccttgctgatgtggaagtggccagggccctcatggaggctgggcagaagcccaagagcaggctctaaagctgccaaacccggcagccctggtccccggaggctcttgccagtctgacagtgttcttggcactgctcagaggtcccagcagctggggttccccctcagcccgtgagcagccatgtccaaccccagcgccccaccaccatatgaagaccgcaaccccctgtacccaggccctccgccccctgggggctatgggcagccatctgtcctgccaggagggtatcctgcctaccctggctacccgcagcctggctacggtcaccctgctggctacccacagcccatgccccccacccacccgatgcccatgaactacggcccaggccatggctatgatggggaggagagagcagtgagtgatagcttcgggcctggagagtgggatgaccg

SEQ ID NO: 7085 - DNA, 1037 bp, Homo sapiens
aacactccgaggccaggaacgctccgtctggaacggcgcaggtcccagcagctggggttccccctcagcccgtgagcagccatgtccaaccccagcgccccacccacccgatgcccatgaactacggcccaggccatggctatgatggggaggagagagcagtgagtgatagcttcgggcctggagagtgggatgaccggaaagtgcgacacacttttatccgaaaggtttactccatcatctccgtgcagctgctcatcactgtggccatcattgctatcttcacctttgtggaacctgtcagcgcctttgtgaggagaaatgtggctgtctactacgtgtcctatgctgtcttcgttgtcacctacctgatccttgcctgctgccagggacccagacgccgtttcccatggaacatcattctgctgaccctttttacttttgccatgggcttcatgacgggcaccatttccagtatgtaccaaaccaaagccgtcatcattgcaatgatcatcactgcggtggtatccatttcagtcaccatcttctgctttcagaccaaggtggacttcacctcgtgcacaggcctcttctgtgtcctgggaattgtgctcctggtgactgggattgtcactagcattgtgctctacttccaatacgtttactggctccacatgctctatgctgctctgggggccatttgtttcaccctgttcctggcttacgacacacagctggtcctggggaaccggaagcacaccatcagccccgaggactacatcactggcgccctgcagatttacacagacatcatctacatcttcacctttgtgctgcagctgatgggggatcgcaattaaggagcaagcccccattttcacccgatcctgggctctcccttccaagctagagggctgggccctatgactgtggtctgggctttaggcccctttccttccccttgagtaacatgcccagtttcctttctgtcctggagacaggtggcctctctggctatggatgtgtgggtacttggt

SEQ ID NO: 7086 - DNA, 2952 bp, Homo sapiens
ctcgctcggtgttcgcccgccgacgccgcacggcttgctggggctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcagttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtattgtcttatggtttcatttgtgttggtccacacagcatgttaggtcagtgtaccagtaaccaatgaaattttgtcaaattccctcactgtactagtttgttaggctgccataacaaagttctacagcttgggtggcttcaacaagaaatttgttttcccacagttctggaggctaaaagtccaagatcaaggtgttagcagggttggtttcctttgaggcctttctctttgatttgtagatggccatcttctccctgtgtctttaaatggccttccctctgtacttgtctgtgcccaaatttcttcttcttatgaggacaccagtcatactggattagggcccacactgaggacctcatttttccttaattatctctttcaaaacctatctccaaatacagtcacattctgaagtgctgggattaggatttcttcatgtgaattttggggggactacaactcagcccataacaccccctaagtatttcccagctattaagttgaaataaacttgtagtatcaatttaagcttgcatgatttgtagatgtaaatttgactttattatcattaactgttgaattatcaagtgtatgatgcagtgcaatcaagtttaacagcatggtgggtaagagcatctagattagaatcattgcagtccaaccaggtgcttaagtgacatttggcgaattatttatccttccttaggtcttctgcctcatcttcataatgggaataatgatgtctagcttattgggctgttataaggattaaatgagatagataaataaactaaactaagtgcttaattaatgtcagctgatggtattaataccattttctttttttttttttttttttttttttaatttatttttttattgataattcttggttgtttctcacagagggggatttggcagggtcatgggacaatagtggagggaaggtcagcagataaacaagtgaacaaaggtctctggttttcctaggcagaggaccctgcagccttccgcagtgtttgtgtccctgattacttgagattagggattggtgatgactcttaacgagcatgctgccttcaagcatctgt

SEQ ID NO: 7087 - DNA, 854 bp, Homo sapiens
gctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggcagagtgctcttttggtggatattgtgcctgtcaggattcttgaagtttttttttatagtgagataatggagttggtcttagccgctgcaggagcccttcttttctgtggattcatcatctatgacacacactcactgatgcataaactgtcacctaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgattaaa

SEQ ID NO: 7088 - DNA, 986 bp, Homo sapiens
ctgttgccatcatggctgaccgacccccggtaccctcgctctcgatcgaggacgacttcaactatggcagcagcgtggcctccgccaccgtgcacatccgaatggttctccagagagattgtaccttcagcaaacaatatatgaggataccttctgcaccctcagccacactgaatatcatcagattttttcatctccggcaatctggtagatcagggatggtgaacattttctacaaagggccaacctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggacttgaagtttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaatgagaaaaaaggattaaagtaattggaagcagtatatagaaactgtttcattaagtaataaagtttgaaacaatgatt

SEQ ID NO: 7089 - DNA, 972 bp, Homo sapiens
gtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcaggccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaaaacatggctaaaagcttacggagtaagtggaaaagaaagatgcgtgctgaaaagagaaaaaagaatgccccaaaggaggccagcaggcttaaaagtattctcaaactagacggtgatgttttaatgaaagatgttcaagagatagcaactgtggtggtacccaaacccaaacattgccaagagaaaatgcaatgtgaggtaaaagatgaaaaagatgacatgaaaatggagactgatattaagagaaacaaaaagactcttctagaccagcatggacagtacccaatatggatgaaccaaaggc

SEQ ID NO: 7090 - DNA, 2833 bp, Homo sapiens
agagcacatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaac

SEQ ID NO: 7091 - DNA, 2598 bp, Homo sapiens
ttctgcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaaca

SEQ ID NO: 7092 - DNA, 3254 bp, Homo sapiens
acagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaaccttt

SEQ ID NO: 7093 - DNA, 1361 bp, Homo sapiens
acatccggtgttagaagcgctggtaggccttggagaggcgggttaggaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctacta

SEQ ID NO: 7094 - DNA, 2669 bp, Homo sapiens
agtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcaggtgaggtggctttgctttgcttggtcttgaggttttgtgggcgtctttctaagtctgctcagcaagggcgtcgttgggcagtttttatcttgggcctacttgctggacctgtggtaacaagtaggctttggtatctttgtatatttactgagtgtagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagctaggcctaagattttgagttaacatctcttgaagccaaactccaccttctgtgctttttgcttgggataatggagtttttctttagaaacagtgccaagaatgacaagatatt

SEQ ID NO: 7095 - DNA, 556 bp, Homo sapiens
ttccttaaaatttggacttgtacagtaaggacttcaactgaccttcctcagactgaggactgttcccagtgtatacatcaagtcactgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggta

SEQ ID NO: 7096 - DNA, 521 bp, Homo sapiens
agagcacatccggtgttagaagcgctggtaggccttggagaggcgggttaggaagtagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagg

SEQ ID NO: 7097 - DNA, 669 bp, Homo sapiens
ggcgagtcagagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtttctaaccaaactgcatgcagcccttcgtagtttttatacacattttgttttccaaagatggtgttcgagaccaaggagagaaaggctgtctccttgacttaaaggttacctaagtgaccccttgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagg

SEQ ID NO: 7098 - DNA, 640 bp, Homo sapiens
tgggcgagtcagagcacatccggtgttagaagcgctggtaggccttggagaggcgggttaggaagagtttctaaccaaactgcatgcagcccttcgtagtttttatacacattttgttttccaaagatggtgttcgagaccaaggagagaaaggctgtctccttgacttaaaggttacctaagtgaccccttgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgta

SEQ ID NO: 7099 - DNA, 582 bp, Homo sapiens
gaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacaggagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctca

SEQ ID NO: 7100 - DNA, 551 bp, Homo sapiens
gaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacaggacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaagagtggagactgctgcacggactctggaaccatgaacatatttgatcgaaagatcaactttg

SEQ ID NO: 7101 - DNA, 469 bp, Homo sapiens
tggcggcctcagccggcatcgaatcaccgcggttcccagagggcgtgaggggctggcgtggacacaccgggaatggaccgtaccctttttcaaaaggaactcatgatgtatacaaatagaatgctcttccccttctttgctggccaattcctactcatctgttaaaaccaagcttagagattacctctttgatgacatctctaccaagtctgattgagaacatctctgtgagcacatagtattctaacatctctatcatcataccatgaaatcatcagactaaagccagaatcccaagactgcagcgctaccccttcacaagccgtcgggctgtcccgggcggggccggcccattttcactttctccactagaggcagcagcgcaccgtgaccctggcttactacgagtggagactgctgcacggactctggaaccatgaacatatttgatcgaaagatcaactttgat

SEQ ID NO: 7102 - DNA, 373 bp, Homo sapiens
agagcacatccggtgttagaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctgagtggagactgctgcacggactctggaaccatgaacatatttgatcgaaagatcaactttgatgcgcttttaaaatttt

SEQ ID NO: 7103 - DNA, 446 bp, Homo sapiens
tagagacgggcttttgccaagttgtccagcctggtctcgaactccacacctcaagcgattcgcccgccttgacctcccaaattgctaggattacaggtgtaatcctttcctaaagaaaaagagtcatctctcctgaagaataagaaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgct

SEQ ID NO: 7104 - DNA, 2771 bp, Homo sapiens
agaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaa

SEQ ID NO: 7105 - DNA, 759 bp, Homo sapiens
ggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagacagggtttcgccgtgttggccagactggtctcgaactcctgacgtcaaagtgatccacctgcctcggcctcccaaagtactgggattacaggcgtgagccactgtgcccaacctgtaagtcatttttgagtcaacgatatttttaatttacaatgggtgtatccagatgtaagccatcgcaaatcaaggagtgtaccgaatgagtatcaatttctcccagtgataggtcaaccctgagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacagg

SEQ ID NO: 7106 - DNA, 538 bp, Homo sapiens
aagtgggcgagtcagagcacatccggtgttagaagcgctggtaggccttggagaggcgggttaggaagagacagggtttcgccgtgttggccagactggtctcgaactcctgacgtcaaagtgatccacctgcctcggcctcccaaagtactgggattacaggcgtgagccactgtgcccaaccttggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctg

SEQ ID NO: 7107 - DNA, 761 bp, Homo sapiens
gggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtat

SEQ ID NO: 7108 - DNA, 533 bp, Homo sapiens
gttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgagaattactacccggtgccagcccgggctgcttggggtcatcagcctttcattgaccacccccacaacaaaaatcactatgaacttgagactgtgttctagcaacttgtgaatgtgtaacccagtagaagggctgactgtgcttgaaacagacaaggattttaaggtcaaagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcagggg

SEQ ID NO: 7109 - DNA, 423 bp, Homo sapiens
tcagccggcatcgaatcaccgcggttcccagagggcgtgaggggctggcgtggacacaccgggaatggaccgtaccctttttcaaaaggaactcatgatgtatacaaatagaatgctcttccccttctttgctggccaattcctactcatctgttaaaaccaagcttagagattacctctttgatgacatctctaccaagtctgattgagaacatctctgtgagcacatagtattctaacatctctatcatcataccatgaaatcatcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcg

SEQ ID NO: 7110 - DNA, 731 bp, Homo sapiens
ctcagaggagagagcaacaaccttagtaggttctgcagcttctcactgtatctgtccttaagaacagaattaacaaaagttctgagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctgg

SEQ ID NO: 7111 - DNA, 2964 bp, Homo sapiens
agagcacatccggtgttagaagcgctggtaggccttggagaggcgggttaggaagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaacggcagaggcgggaagtgagaggagtctggggctggggctgccttccaggcccacggggcggccccgctcttttcggattggttacctttgggcagagtggagactgctgcacggactctggaaccatgaacatatttgatcgaaagatcaactttgatgcgcttttaaaattttctcatataaccccgtcaacgcagcagcacctgaagaaggtctatgcaagttttgccctttgtatgtttgtggcggctgcaggggcctatgtccatatggtcactcatttcattcaggctggcctgctgtctgccttgggctccctgatattgatgatttggctgatggcaacacctcatagccatgaaactgaacagaaaagactgggacttcttgctggatttgcattccttacaggagttggcctgggccctgccctggagttttgtattgctgtcaaccccagcatccttcccactgctttcatgggcacggcaatgatctttacctgcttcaccctcagtgcactctatgccaggcgccgtagctacctctttctgggaggtatcttgatgtcagccctgagcttgttgcttttgtcttccctggggaatgttttctttggatccatttggcttttccaggcaaacctgtatgtgggactggtggtcatgtgtggcttcgtcctttttgatactcaactcattattgaaaaggccgaacatggagatcaagattatatctggcactgcattgatctcttcttagatttcattactgtcttcagaaaactcatgatgatcctggccatgaatgaaaaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaatgtcccaagcaaggatagggaaggggaatggttgagcctctggagatcattgtaaccaatcctgccagacctgtttggggcagtggggagcaaacctagataaggacctgtttggggcagcagggagcaaaatctcctttaacaaccaagcagttcctcattcacatcaacagagcgaggctgtgataacttaggaggcagcaatcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaa

SEQ ID NO: 7112 - DNA, 3551 bp, Homo sapiens
tctctggccagcttctgattgttagcagtgggttagctcccatgaaaacctcgaaggcatcccagcgctatagaggcatccggagaaatgccagccagtgctacctctaccaggaatctctgctgctcagcaacttggatgacagctttagtgctgatgaaacaggggacagcaatgatccggaacaaatcttccagaatatacagttccagaaagatctcatggcaaacattcgctgcagaccctggactatgggacagaagctgagggcattgagacaagcgaagaacattgtgctgaagtttgaagggaggctgaccaggacccgaggctaccaagcagcaggtgcagagctctggcggaaatttgctcgtctcgcctgtaactttgtggtcatcttcattccctgggaaatgaggataaagaaaatcgagagtcattttggatctggcgttgcctcctatttcatattcttgagatggttatttggaattaatattgtgctcaccattatgacaggtgcttttattgtcattccagagctgattgcaggccagccctttggaagcacagccaggaagaccatccccaaggagcaggtttcgtctgcccaagacctggacaccgtctggtctctggggggctacctccagtactctgtcctcttctacggatattacggcagggagaggaagatcgggagagctggctaccggctgcccttggcgtatttcctagtggggatggcagtgtttgcttacagcttcatcattcttttaaaaaagatggctaagaactcccgcacgagtcttgccagtgcttccaatgaaaactataccttctgctggcgggtgttctgtgcctgggattacctcattggaaacccagaggctgcagagagcaaaacagctgccatagtgaacagcatcagggaagctatattggaagaacaggagaaaaagaaaagcaaaaacctggcagtgaccatctgcctgaggattattgccaacatcctggtgcttctctcactggctgggagcatttatctcatctactttgtggtggaccggtcccagaagctggagcagtcgaagaaggagctgacactttgggaaaagaatgaggtcagtgtggtggtctccctcgtcaccatgatagcaccatcagcctttgacctcattgctgccttagagatgtaccaccccaggaccacgctgcgcttccagcttgcaagggtccttgtgctgtatttgggaaatctctacagcctgatcattgctctcctggacaaagttaacagcatgagcattgaggaaatggctaccaaaaataacacaagtcattggatagattccaccaccttctttgcaaccaggacagcccctgaagaagagaaatggtccacatctcggcctggaatggggctcaggagaaacaacacatgggccttggaagagaccagcatttcagcttataccatgcctcttataaaggccaacaagactagcctccacactcagagtccacaagaccagtgctgggagacatacgttggtcaggagatgctgaagctctccatcattgacatgctcttcaccgtggcgagcattctgctcatagacttcttccgaggacttttcgtgcggtacttaagtgactactggtgttgggatctggagagcaagtttcctgaatatggagaattcaaaatagctgagaatgtgctacatttagtctacaaccaaggaatgatttggatgggggccttcttctccccatgtctcccagcgttcaacgttctcaaactcattgggctcatgtacctgagaagctgggctgtgctgacctgcaatgtgccccaccagcaagtatttcgagcctcaagatccaacaacttctacttggcaatgctcctgtttatgctgtttctgtgcatgctgccaaccatttttgctattgtccgatacaagccatctctaaactgtgggccattcagtggacaagagaaaatttatgacattgtgtcagaaacgattgagaaagactttcctgtgtggtttggctccgtggttggacacatcagtagccccgtggtcatcctgcccgcagtactcctgcttttcatgctcatctattatctccagagcatcgcacggtctctaaagctcagcaaccaccagctcaaaatgcagatccaaaacgcaagatcagaggataagaaaaaggttgcccagatggtagaagcccgaatccagacccaggaagaaagcaccaagaagcttccaaacgacagtgatcttaccagccagctgtcctcagcgcactcgggcacaccccaaaacaacggcaacgtggcccattttgactcagggagcagcaagagtggcaggatagagacagtcgcacagtccatgccccagagcccgaggccaggggacagggctcctagctcacctctccctggggtccccaaatccaggctagagcatgaaactaacaggtatctgcacggtctgtgtgcaagcaccagtgaccttcacaggaacagatcgcgcacacctatgacatttacaacgcacatcgaagatgtacactcagaacctcttttccgaaaagactttcagcaaatcaaccctcctcaccgtggaccacaggcctcgactttgctggcacagggtcccaggccccacgcccccagatactatgtcattaatgaatgtgactcttacaagaaaaaacatctaaatgtctggccagaaagacatttcaagatagatgcttcaggtgacattgtggagctgtaccccaggaacgtgcgacaatatgcatcccgggtcccccgccagcctccctccccacagctgagtgaagaagaggaggagacgccaagcagagattggatcaaacggtctcttcccccacgctccctgatagacctccgtcgggctcctcatttttatattggggagaggtccgaaagtcagacccgggatcccgagcaccaggggagggtgcactacaagtcgtggaatgaagattttgagggtcaccttgagaggccagcctatgtgcccagaaagccacgatcccggaatttccaatacccacagccccctctgaagcccagagggaagcccaggttcgagccatccctcacggaatctgactccgtgtcggcagcatccagcagtgaccagcagaacagcagcgctgaccagtacctgcaggtcacccacagccagggcaggttcccgaggtccgtgggccagcccagcaggaggaaggccaagtcggggcaggagctgaccgtggatctggatgacttgatttgttcagatgtctaggcttcctccagtgtcccgttcctagaggtcaggcccctgttggagtgctgggccagcacatggcatctccctttctggaaaaagaggtgaacaagtgtgttagagacctgaggggcatggtcagcggctgctagctgaggccctgaggctgacagggctacagatacctattctacagctactgttagccaaatttatccgagttag

SEQ ID NO: 7113 - DNA, 4644 bp, Homo sapiens
acacagtcttcttcctgagaactagcgggcagagcaaactccgctgcttccattcagaaacctcggaacagacctttgcctgccaacttcctagctctctggccagcttctgattgttagcagtgggttagctcccatgaaaacctcgaaggcatcccagcgctatagaggcatccggagaaatgccagccagtgctacctctaccaggaatctctgctgctcagcaacttggatgacagctttagtgctgatgaaacaggggacagcaatgatccggaacaaatcttccagaatatacagttccagaaagatctcatggcaaacattcgctgcagaccctggactatgggacagaagctgagggcattgagacaagcgaagaacattgtgctgaagtttgaagggaggctgaccaggacccgaggctaccaagcagcaggtgcagagctctggcggaaatttgctcgtctcgcctgtaactttgtggtcatcttcattccctgggaaatgaggataaagaaaatcgagagtcattttggatctggcgttgcctcctatttcatattcttgagatggttatttggaattaatattgtgctcaccattatgacaggtgcttttattgtcattccagagctgattgcaggccagccctttggaagcacagccaggaagaccatccccaaggagcaggtttcgtctgcccaagacctggacaccgtctggtctctggggggctacctccagtactctgtcctcttctacggatattacggcagggagaggaagatcgggagagctggctaccggctgcccttggcgtatttcctagtggggatggcagtgtttgcttacagcttcatcattcttttaaaaaagatggctaagaactcccgcacgagtcttgccagtgcttccaatgaaaactataccttctgctggcgggtgttctgtgcctgggattacctcattggaaacccagaggctgcagagagcaaaacagctgccatagtgaacagcatcagggaagctatattggaagaacaggagaaaaagaaaagcaaaaacctggcagtgaccatctgcctgaggattattgccaacatcctggtgcttctctcactggctgggagcatttatctcatctactttgtggtggaccggtcccagaagctggagcagtcgaagaaggagctgacactttgggaaaagaatgagcaggtcagtgtggtggtctccctcgtcaccatgatagcaccatcagcctttgacctcattgctgccttagagatgtaccaccccaggaccacgctgcgcttccagcttgcaagggtccttgtgctgtatttgggaaatctctacagcctgatcattgctctcctggacaaagttaacagcatgagcattgaggaaatggctaccaaaaataacacaagtcattggatagattccaccaccttctttgcaaccaggacagcccctgaagaagagaaatggtccacatctcggcctggaatggggctcaggagaaacaacacatgggccttggaagagaccagcatttcagcttataccatgcctcttataaaggccaacaagactagcctccacactcagagtccacaagaccagtgctgggagacatacgttggtcaggagatgctgaagctctccatcattgacatgctcttcaccgtggcgagcattctgctcatagacttcttccgaggacttttcgtgcggtacttaagtgactactggtgttgggatctggagagcaagtttcctgaatatggagaattcaaaatagctgagaatgtgctacatttagtctacaaccaaggaatgatttggatgggggccttcttctccccatgtctcccagcgttcaacgttctcaaactcattgggctcatgtacctgagaagctgggctgtgctgacctgcaatgtgccccaccagcaagtatttcgagcctcaagatccaacaacttctacttggcaatgctcctgtttatgctgtttctgtgcatgctgccaaccatttttgctattgtccgatacaagccatctctaaactgtgggccattcagtggacaagagaaaatttatgacattgtgtcagaaacgattgagaaagactttcctgtgtggtttggctccgtggttggacacatcagtagccccgtggtcatcctgcccgcagtactcctgcttttcatgctcatctattatctccagagcatcgcacggtctctaaagctcagcaaccaccagctcaaaatgcagatccaaaacgcaagatcagaggataagaaaaaggttgcccagatggtagaagcccgaatccagacccaggaagaaagcaccaagaagcttccaaacgacagtgatcttaccagccagctgtcctcagcgcactcgggcacaccccaaaacaacggcaacgtggcccattttgactcagggagcagcaagagtggcaggatagagacagtcgcacagtccatgccccagagcccgaggccaggggacagggctcctagctcacctctccctggggtccccaaatccaggctagagcatgaaactaacaggtatctgcacggtctgtgtgcaagcaccagtgaccttcacaggaacagatcgcgcacacctatgacatttacaacgcacatcgaagatgtacactcagaacctcttttccgaaaagactttcagcaaatcaaccctcctcaccgtggaccacaggcctcgactttgctggcacagggtcccaggccccacgcccccagatactatgtcattaatgaatgtgactcttacaagaaaaaacatctaaatgtctggccagaaagacatttcaagatagatgcttcaggtgacattgtggagctgtaccccaggaacgtgcgacaatatgcatcccgggtcccccgccagcctccctccccacagctgagtgaagaagaggaggagacgccaagcagagattggatcaaacggtctcttcccccacgctccctgatagacctccgtcgggctcctcatttttatattggggagaggtccgaaagtcagacccgggatcccgagcaccaggggagggtgcactacaagtcgtggaatgaagattttgagggtcaccttgagaggccagcctatgtgcccagaaagccacgatcccggaatttccaatacccacagccccctctgaagcccagagggaagcccaggttcgagccatccctcacggaatctgactccgtgtcggcagcatccagcagtgaccagcagaacagcagcgctgaccagtacctgcaggtcacccacagccagggcaggttcccgaggtccgtgggccagcccagcaggaggaaggccaagtcggggcaggagctgaccgtggatctggatgacttgatttgttcagatgtctaggcttcctccagtgtcccgttcctagaggtcaggcccctgttggagtgctgggccagcacatggcatctccctttctggaaaaagaggtgaacaagtgtgttagagacctgaggggcatggtcagcggctgctagctgaggccctgaggctgacagggctacagatacctattctacagctactgttagccaaatttatccgagttaggtggcaccaaagtatgtcaccagcagtgaatcatcacgggtctgcagcaatctcaatacttgcctcctcggaagaaagaatttggcagaggggctcaagacagaaggagagactgaggcaagttttagagcaggcatgaaagtttactgaaaagctttaaagcaggaatgaaagaacgtaaaacatacttagtagagggccaagcaggcgacttgagagatccagtgcactgtttgacctttgacttggggttttacacgttggcatgcttccggggtcttgcgttgcttctccccacgattcttccctttcttcccttggggtgggctgtccgcatgcgcagtagtggcctgctagcgctggggaggggagcatgcgcagtgtgtttactggagttgtgcacgcgctcactcgaggttcttcccttaccaggggaatgctccattttgtctcttagtgcgcatgtttgagcccactcgcccaactcctgacattttatggggaagctgccgatcaccagtttcaggttttttctatctattgggagactgtcgttccctggtgccagctgtgaccaattattattttagagagacaatcagcagccacctgaccatcacctgatggtcgcctgacattcctgggggttgtgttgaagaaggaattcatgaattttacaagtataatcaaagacaaccaaaaatttttactttttccttcaaaagctaagtgtagtgtagctcccccatagtctaagttaaagaagaacactaactgcctgtttttccttctgtgctcagcaagccttatctgtacttgctagtttcacattccttgaggctcagcgagttcctgcttcaccaccctagcgcagctgcaaagttacaaggttgatgcagaaacatggtttcccagggatgtggaacatgtagtatagataaatgtaaaagactgaacaactgcctttgctctcgcttctgtaagtacgcttcctg

SEQ ID NO: 7114 - DNA, 2371 bp, Homo sapiens
ttacctggggcagtgtctgcctggtggccactagagacagcccagcctgggccatggaagaaaacccgaccttggaatcagaagcctggggctcctctagggggtggctggccccccgggaggccagaggaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtcctgactctcgggtgatcttccttgtatcaataaatacagccgaggttgctga

SEQ ID NO: 7115 - DNA, 2412 bp, Homo sapiens
ctgagaaaccacaggaagtgtaccttactccctccgggccacctgctggccaggtacacacctgcccctggcccctcccttacctggggcagtgtctgcctggtggccactagagacagcccagcctgggccatggaagaaaacccgaccttggaatcagaagcctggggctcctctagggggtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgcca

SEQ ID NO: 7116 - DNA, 1081 bp, Homo sapiens
atgaagggtgggggcggtcagagggatgttggcgctgacaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaggagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctttgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagacagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtcctgactctcgggtgatcttccttgtatcaataaatacagccgaggttgctg

SEQ ID NO: 7117 - DNA, 3687 bp, Homo sapiens
acagaattctctgcaggaaaacactccttctcctgagaaaactcctcaggggttagatgcagggagttatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacaggttgagaatgtttcctctggggtccaaagccacccatcctcaaatcagatttttcaagaaaaggtgctgctagactcaagcatcaacatggttttgtcaatatctgacattgatgtgatagactctcagacagtcagcaaaaggaatgaccaaaagggtaaccaggtgctgcggttttcaacatctttgaatgagtcgatgtctcagacccttcatagcctagaatgcatgggcatagacactcctggttcttcacatgaaactgttcaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 7118 - DNA, 4755 bp, Homo sapiens
cagggtcgacccgagggccagcgcaagcagcggcaacaggagcgccaggaggtgaggcgggttcgccaggagtggggccagcgcccgggctgccagcctagcaggggcgtcttggcggagccccctcgccggctcccagagaggctgggaagaactgggaggggtgtccccaatgcggggcgcccaagcgtggcagcacgggctgggagcggggagccagcggggtgcggcgccggagtgcggggagaaccaccaggcgccggaattggggagcacgtggagggggcagcggctccagccccagaccgccgcgctctgtcactttgcattaagaaagcttccggggaatgcacacggcctggccgccgccttcgtgcagcccgccctgcaggtgcaggaagaaaagaataatcgcacccgtttctcaggtgcttacttcaccatgtccgatccggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 7119 - DNA, 4917 bp, Homo sapiens
gagggccagcgcaagcagcggcaacaggagcgccaggaggtgaggcgggttcgccaggagtggggccagcgcccgggctgccagcctagcaggggcgtcttggcggagccccctcgccggctcccagagaggctgggaagaactgggaggggtgtccccaatgcggggcgcccaagcgtggcagcacgggctgggagcggggagccagcggggtgcggcgccggagtgcggggagaaccaccaggcgccggaattggggagcacgtggagggggcagcggctccagccccagaccgccgcgctctgtcactttgcattaagaaagcttccggggaatgcacacggcctggccgccgccttcgtgcagcccgccctgcaggtgcaggaagaaaagaataatcgcacccgtttctcaggtgcttacttcaccatgtccgatccggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgctatttttaatacctggattgctgatttttcaagacaaaatacttggggttttccaataaagattgttgtaatattgaaatgagcctacaaaaacctaggaagagataactagggaataatgtatattatcttcaagaagtgtgtgcaggaatgattggttcttagaaatctctcctgccagacttcccagacctggcaaaggtttagaaactgttgctaagaaaagtggtccatcctgaataaacatgtaatactccagcagggatatgaagcctctgaattgtagaacctgcatttatttgtgactttgaactaaagacatcccccatgtcccaaaggtggaatacaaccagaggtctcatctctgaactttcttgcgtactgattacatgagtctttggagtcggggatggaggaggttctgcccctgtgaggtgttatacatgaccatcaaagtcctacgtcaagctagctttgcagtggcagtaccgtagccaatgagatttatccgagacgcgattattgctaattggaaattttcccaataccccaccgtgatgacttgaaatataatcagcgctggcaatttttgacagtctctacggagactgaataagaaaaaagaaaagaaaagaaattagctgggtgcgatggcttatgcctgtaatcccggcactttgggaggctgaggcaagcggatcacttaatgtcaggagttcaagaccagcctggccaacatggtgaaaccccgtctctactaaaaataaaaaaactagctgggcgtggtggtacatgcctataatcccagctactcgggaggctgaggcaggagaattgcttgaacctgggaggcagaggttgcagtgaggcgagattgtaccactgcattccagcctgggcaacagtgagactctgcctcaaaaaaataaataaataaataaataaagtaaattaaaagtcttattcaaaccaaa

SEQ ID NO: 7120 - DNA, 2433 bp, Homo sapiens
tatgttgtgatttgtgtaggggtggctttggtgagctcatcctggcattttaaaaataatgtgaatggtgtatccctttgtgatcatcatcactttttccctgcgagtcccaatcaatgcgggtgtgactgctgtatgaagtctcaggaagcccaccccagtggagaagaaggcttgcaggaggcaggagatgctgtccgatgaccacgtgaatgaaatcatcatacagaagttaatcgcatcccttatacccatgacatccagagacagaattaaagccatcaggaaccagccaaggaccatggaagagaaaaggaaccttagcaggggaggcctcacaatcacgacagaggacgaaggaagagcaaaggcacatcttacgtggtggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggcttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgct

SEQ ID NO: 7121 - DNA, 3581 bp, Homo sapiens
aggtaaggctgggtcatggaaagaaagaatgaatgcagactacgggcggtgaatagaggtctcggatgccagcaggcgtcccaacccagcaggaactggctcaattctcagaagaaagcgatcggccccgaggcaggaaggccggctccggtgcagggagcgccgcctgcgggctgcttcgggccagggtcgacccgagggccagcgcaagcagcggcaacaggagcgccaggaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataaggttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgggcattccatgct

SEQ ID NO: 7122 - DNA, 3887 bp, Homo sapiens
aacttgggacctgagttaggccttcatcgtcgcggactcagtagacagaggccataggtgcagctgtgatggtagaggtggaagactgatttgcattttcaccaggtgagacctggttactcattggttgatgaggaaagagatgatagccagggcggcataaaacggcaatgagctcagtaaacaacccccttcccgtgatcttcgtggcttcccgcccagacgtgtgaccaagatagcaaggagcagtctttaaggcgacacggcagagaggcagaaaaagatgggccttaccggttagttaagaaaaaaagaggacctgttgcctgtccctctagctttgaactacaaagtggaggggaagtttgtctggattttcctgtagaactgagggcaggacatgaggctctgcctgcagtcagcaacttggaatattcagacttcagaccagcatcacagattataaccctccgtaaatcatctgcatcccagctcccatcaaaagccagcctgaaggacccatggacacgtgactccagtgttctcaacaacatcttaagatcaagttggtttgcacaacatttgcatctacttgggacaaagcaagaacaataagggcaaaaaagtgaaaaaaaaaaaagatccctgagtaattgcaaatgctgggacagtttaccactccagggtgaagagtccataccaacatgtctgcctactacaggaataactggtctgaggaagacccagattaccctgactattcagggtctcagaaccgtacgcaggggtatttgaaaactcaaggttatccagatgttccaggtcctctgaacaatccagactaccccggcaccaggagcaatccatactctgtagcctccagaacacgtccagactatcctgggtctctggcagaaccaaattatcctagatctctgagtaatccagactattctggcaccagaagcaatgcatactctgcagcctctagaacaagcccagaccatcctacctctctaccagagccagattatagtgaatttcagagtcatccctaccaccgagcatcatccagacaaccagactaccctggatctcaacgaaatcctgattttgcaggctccagcagcagtggaaactatgcaggctccagaacacatccagatcattttggctccttagaaccggactaccctggagctcagagcaactctgatcatcctggacccagagccaatttgaaccatccaggatccagaaagaatctggaacatacaagttttagaatcaatccatacgcagactctctgggaaagcctgattatccaggcgctgacattcaacctaactctccacccttttttggggagccagactatcccagtgctgaggacaatcagaacttgccaagcacttggagagaacctgattattcagatgctgagaatggtcatgattatggctcttctgagaccccaaagatgaccaggggggtgctcagcagaacatcttcaatccagccctcatttcgtcacaggagtgatgaccccgtgggcagtctttggggagagaatgattaccctgaaggcattgaaatggcatccatggagatggcaaactcatatggccactctctgccaggtgctcctggaagtggctatgtgaaccctgcttatgtaggtgaaagtggtcctgtccatgcttatggaaacccaccattgtctgaatgtgattggcacaagtcaccccaaggacagaagttaatcgcatcccttatacccatgacatccagagacagaattaaagccatcaggaaccagccaaggaccatggaagagaaaaggaaccttaggaaaatagttgacaaagaaaaaagcaaacagacccatcgtatccttcagctcaattgctgtattcagtgtctgaactccatttcccgggcttatcggagatccaagaacagcctgtcggaaattctgaattccatcagcctgtggcagaagacgctgaagatcattggaggcaagtttggaaccagcgtcctctcctatttcaactttctgagatggcttttgaagttcaacattttctcattcatcctgaacttcagcttcatcataatccctcagtttaccgtggccaaaaagaacaccctccagttcactgggctggagtttttcactggggtgggttattttagggacacagtgatgtactatggcttttacaccaattccaccatccagcacgggaacagcggggcatcctacaacatgcagctggcctacatcttcacaatcggagcatgcttgaccacctgcttcttcagtttgctgttcagcatggccaagtatttccggaacaacttcattaatccccacatttactccggagggatcaccaagctgatcttttgctgggacttcactgtcactcatgaaaaagctgtgaagctaaaacagaagaatcttagcactgagataagggagaacctgtcagagctccgtcaggagaattccaagttgacgttcaatcagctgctgacccgcttctctgcctacatggtagcctgggttgtctctacaggagtggccatagcctgctgtgcagccgtttattacctggctgagtacaacttagagttcctgaagacacacagtaaccctggggcggtgctgttactgcctttcgttgtgtcctgcattaatctggccgtgccatgcatctactccatgttcaggcttgtggagaggtacgagatgccacggcacgaagtctacgttctcctgatccgaaacatctttttgaaaatatcaatcattggcattctttgttactattggctcaacaccgtggccctgtctggtgaagagtgttgggaaaccctcattggccaggacatctaccggctccttctgatggattttgtgttctctttagtcaattccttcctgggggagtttctgaggagaatcattgggatgcaactgatcacaagtcttggccttcaggagtttgacattgccaggaacgttctagaactgatctatgcacaaactctggtgtggattggcatcttcttctgccccctgctgccctttatccaaatgattatgcttttcatcatgttctactccaaaaatatcagcctgatgatgaatttccagcctccgagcaaagcctggcgggcctcacagatgatgactttcttcatcttcttgctctttttcccatccttcaccggggtcttgtgcaccctggccatcaccatctggagattgaagccttcagctgactgtggcccttttcgaggtctgcctctcttcattcactccatctacagctggatcgacaccctaagtacacggcctggctacctgtgggttgtttggatctatcggaacctcattggaagtgtgcacttctttttcatcctcaccctcattgtgctaatcatcacctatctttactggcagatcacagagggaaggaagattatgataaggctgctccatgagcagatcattaatgagggcaaagataaaatgttcctgatagaaaaattgatcaagctgcaggatatggagaagaaagcaaaccccagctcacttgttctggaaaggagagaggtggagcaacaaggctttttgcatttgggggaacatgatggcagtcttgacttgcgatctagaagatcagttcaagaaggtaatccaagggcctgatgactcttttggtaaccagacaccaatcaaataaggggaggagacgaaaatggaatgatttcttccatgccacctgtgcctttaggaactgcccagaagaaaatccaaggctttagccaggagcggaaactgactaccatgtaattatcaaagtaaaattgg

SEQ ID NO: 7123 - DNA, 3622 bp, Homo sapiens
tcagcgccggaacctggaatcccggctccgcgagggaaggccggggaggcggcggcggcggcggcggctggagagggtcctcggcagcctctgaggagcgcggggcgcggccatgagcgagtccagcggcagtgcgctccagcccggcaggcccagccggcagccggcggtccatccagagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaa

SEQ ID NO: 7124 - DNA, 4495 bp, Homo sapiens
ttccttattcctgctccctccacaaacgcgtcctcatccaatccagtggaacccagccgggccaaaaggacacgagaactgcagtctggaccgtggtgggtttgtcttccagctgttgaccgagacagtctttcaatagcctcatctgctgttaaatgaaaggatttgagcaccccctccacgcctaacattctggtatgaggtgcctgcctcccggacatttcagccttcacatacagttagaccaacttgaaaccgaattctgccttgtctgtttattgctgtgggacctttgagaacctctctctagactccagttgcttctcttctccacctgtgaacttcctccaagaattgccaagctaccggtccattgcacgtaggagaacgactgtccattcccgggacaagcaaagcggaactttgctaaagccaaccgactcttacagctcccagctggaggacagaatcgctgaaaacctcagcagccattctcttcgaaattatgcactgaacatctctgagaagcggagactaagggacattcaagagacacaaatgaagtatctctccgaatgggaccagtggaagcggtatagcagcaagtcttggaagaggttcctagagaaggctcgagagatgacgacccacctggagctgtggcgggaggacatccgcagcatagaagggaaatttggcactgggattcagtcctatttctccttcttgagattcctggtgttgctgaatttggtgatatttctgatcatctttatgctggttttgctcccagtcttactcacgaaatacaagatcaccaacagcagcttcgtgctcattcctttcaaagacatggataaacaatgtacagtctatccagtaagcagttctggactcatttacttttacagttatatcatagacttgctttctggcactggtttcctggaggaaactagcctcttttacggacattacaccattgatggggtgaaatttcagaacttcacctatgatctgcccctggcgtatttgttaagcacaatcgcctccctggccctgagccttctttggatagtgaaaaggtcggtggaaggattcaaaatcaacctgattcggagtgaggagcactttcagagttactgcaacaagatatttgccggctgggacttctgcatcactaaccgcagcatggcggatctgaagcacagcagcttgcggtacgagctccgagcagatctggaggaagaaagaatgcggcagaaaatagcagaaaggacctcagaagaaacaatacgcatttactctttgagactgtttttgaactgtattgttctggctgttttaggggcatgcttttatgcaatatacgtagcaactgtcttctcgcaagagcacatgaaaaaggaaatcgacaagatggtttttggagagaacctcttcatattgtatctaccgtctattgtgatcacgctggccaattttatcaccccaatgatctttgccaagatcatccgctatgaggattattctccaggctttgagatccgtctgacaatccttaggtgtgtctttatgcggctggccaccatatgtgtcctggtgttcacgctgggctccaagatcacatcctgtgatgatgacacatgtgacctttgcggctacaaccagaaactctacccgtgctgggagacccaagttgggcaggaaatgtacaagctgatgatcttcgacttcatcatcatcttggctgtgacactcttcgtggattttcctagaaagctcctggtgacctactgttcctcttgcaagctgattcagtgctgggggcagcaggagtttgccattcctgataacgtcctggggatagtttacgggcaaaccatctgctggatcggagcctttttctcaccccttctccctgcaattgcaaccctgaaattcattatcatcttctatgtgaaagagtggagtctgctttacacctgcagaccctcccccaggccgttcagagcatccaattctaatttcttcttcctgttggtgttgttgatcgggctgtgtttggcaataatacctctgacaatcagcatatcacgcatcccttcctcgaaagcctgtgggccgttcaccaacttcaacaccacctgggaggtcatccccaagacggtgagcaccttccccagctcgctgcagtccttcatccatggtgtcacatccgaagcctttgcagttcctttcttcatgattatttgcctcatcatgttttacttcattgccttagctggagcacacaaacgggtggtcatccagctccgagagcagctatccctggaaagtcgtgacaagtgctacctaatccagaaactaacagaagcccaaagggacatgaggaactaactagactgagcgtgaagatggtgctgcctgttgcttctaagctgacctagtgattctgctgagcctacagagtctacctgggttttgagtggacatttaaaaatatatttttcttgagtttaggcttttccatatgtgcagctgtgtttacctaacccagcccttaattagggcttcagtgacttagaaaagcaggggaaacccaaggctttgcctgcagaccggccactctgtgacaactctaccaaaaaccaacaagccattcaagcttttacaagaatgaaagagcggagacggtagtttagtatttgagccacgagtttatgtgcacaagtgttttgggttgtggactgaagctcagcctgttaatcagaccagcccatgagtgtataacaaacagaattggaggctggtttcttaaacacacacgtccacattttttagggttgttttcctgtgcttacaatttttaatgcatgtgcctttatttcacaaaacatgtggctgggcgcagcggctcacgcctgttatcccaacactttgggaggccgaggcaggcggagcacctaagttggggagttcaagaccagcctgaccaacgtggagaaactccgtctccactaaaatacaaaattagctgggtgtggtggcacatgcctgtaatatcagctactcaggaggctgaggcaggagaattgcttgaacccaggaggtggagtttgcagtgagctgagatcacaccattgcactccagcctgggcaaaaagagcaaaactctccctaaaaaaaaaatgtagaatatctcttaagatttccgttatggtaaaaaccatatgcaataaatacctcattgtaagcttacccaaaattgatagatgtcaaccttttaacagaagaacagaagtttaagttattgtttaatgtaatcagttttcattttaatatctttgaaatctttttcaaaggactgtagttttgtaatggacttttcaagccttccttccattgtttttcttccgttcactggctccacacgtttcctggggagtagcctggaatttaaagttgggtgcaggttttagaaagctgttgctgttaacaataattctcccggccatctccactccactactcaaaaatgcctgaatccttgctcagaggagcaaaggtatcttctcgtccctttcttacagccattttcttgcttttccacaaagatattatttaaagtggaatatttttgtaactgggataccaatgagcttttcggtcttttcctgacttggtaaggtttatgggtttctaaatctaataactacagtcataccaccctgaaaatgcctgatctcgtctaaatctaataactggtgtcatggaattttgagtaaccaaagattcattccagtctcacttaaaaaaataaattctgctgggcacagtggctcatgcctgcaatcccagaactttgggagtccaaggagggcagatcacctgaagtcagaagtttgagaccagcctggtcaatgtggcaagaccccgtctctactaaaagtacaaaaattagccaggcatggtggcgtgtgcctgtaatcccagctacttgggaggctgaggcatgagaatcacttgaacctgggaggtgaaggctgcagtgtgcgagaccgtgccactgtactccagcctaggtgacagagggagaccctatctcaaaaaaaaagataggtgaaaagaaaaaaaaagttgtaattgtaaacatttctgcccagtgcctttatatttatataacattttcactgtgaccagacttgatgatattcaagttttctatttgtgtgtgtgtgtgtgtgtgtgtgtgatgaacacaacgaaaacgtactgcgttttttttcctattataaaagtgatactgaaatatgctaattaatatattaattttagttaaatgctgctaatatgcatacctcttacttgaaggtttttaatatgttttgataactttaataacttcaggtgatgtctgtataacttttaaagtgcagctctctctaacaaatgtgccttacaactcctgattaaacggcgtcttgaaggtttt

SEQ ID NO: 7125 - DNA, 2552 bp, Homo sapiens
ggagcttaggcggcggtggctgagaaggcagcggggcggcggcggcggcggcggcggcggctgtggaggccgcagtccgggtcctggcttcggcctcagccccaccatggtgacgcttgctgaactgctggtgcttctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatggggatgatccaggattatgttgtgactgatacatattagttacttgtgcttttttttttttttttggatctttgcaagggcaaaactacaagtaacgagttttatataattaatttaaatttgttacaggttttcatgttcaggataaaccatacttccaccttgggtgagaacacttgcaacagtttattaatgaggtgactttcaccttaggacaactgttgcatgccaagttttttgtgtgtgtgaaacacttcaaaactgatttaaaagatgtaaatttaaaattggttgtatctaatatgccccaggttcggtaaataaacaattctttttaaaaacagtattctgtgttttatatattgacagctaatccacattttttacacaccaactttctgttcttatttgacatgagacatgttcatgttttctgagtatttatacctattacgtctgttactttttaattctataaacttgaggatagtgaatggtaccaagttttagtttctgcgtaggttttccagtgtggcttctctgatggatcagtgctaaaatcttaagtatttttctatttgggaaaaaagggttgaattattttcacttgcccacgtagtttatgaatgtgggaaatagcttcaaagacagattaaatgatttgcccaaggccacagaaaagagtgaaaggtggaaccggagactagatcaccacctgtagaaactgttcttcctctgtgaaactaacggcctgctggtaataaaagtagc

SEQ ID NO: 7126 - DNA, 1087 bp, Homo sapiens
ttaggcggcggtggctgagaaggcagcggggcggcggcggcggcggcggcggcggctgtggaggccgcagtccgggtcctggcttcggcctcagccccaccatggtgacgcttgctgaactgctggtgcttctggccgctctcctggccacggtctcgggctatttcgttagcatcgacgtggagattacaggaccagataacaaaggaatttacaaaggagacagagaatccagtgggaaatacacatttgctgctcacatggatggaacatacaaattttgttttagtaaccggatgtccaccatgactccaaaaatagtgatgttcaccattgatattggggaggctccaaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgt

SEQ ID NO: 7127 - DNA, 983 bp, Homo sapiens
gagaaggcagcggggcggcggcggcggcggcggcggcggctgtggaggccgcagtccgggtcctggcttcggcctcagccccaccatggtgacgcttgctgaactgctggtgcttctggccgctctcctggccacggtctcgggctatttcgttagcatcgacgcccatgctgaagagtgcttctttgagcgggtcacctcgggcaccaagatgggcctcatcttcgaggtggcggagggcggcttcctggacatcgacgtggagattacaggaccagataacaaaggacaagatatggaaacagaagctcaccagaacaagctagaagaaatgatcaatgagctagcagtggcgatgacagctgtaaagcacgaacaggaatacatggaagtccgggagagaatacacagagccatcaacgacaacacaaacagcagagtggtcctttggtccttctttgaagctcttgttctagttgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgaga

SEQ ID NO: 7128 - DNA, 1475 bp, Homo sapiens
aaggtgcccgggcccactttgagcgcgcggctgcgcactgagccgccggccctcccggaagcgcagagctccgctggtgccacgtctatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtggaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagatggagtccgcctgcgtgaccatccatgaggctctgaaaacggtgattgactcccagacgcattaccggctgcgggaggcccaggaccgggcccgagcagaagaccttaatagccgagtctcttactggtctgttggcgagacgattgccctgttcgtggtcagcttcagtcaggtgctactgttgaaaagcttcttcacagaaaaacgacccatcagcagggcagtccactcctagccccggcatcctgctctagggcccctcatgccccaggctggagcagctctcctaggtcacagcctgctgggctgggtcgcgtagcccagggtggaggcagaacgatgctgctgtggtagccctttgcctttcatgcccatgcttgattcttgcacctcagcagctgaaggtctcagagaccagtaatcagaaggcatccgactgcattaagtgtgcagcgctgaaaagacatttacaactaggccagggattagccactgtgggagggtggacaggcaatggttcagtggcctggctgttggcaggaactccaagtgcccaggcctcttgggcagcttagggccctgcctctgtttcatgatgcatgggtcatttgtcttgggtgtcctatcccatatggagaagaaaggggctctaagttctggctcttctttctttggggttctctgtacctgaggaaaccaggccctgggtgactttgcagatctgctcaccctcggtgagcaacagtgtcagccatgcaagcaggacagaatggtgactgggtgcccttggtgagctgtgtatttcctaggaggtagaaaactgtgggaaactgtggctaataaaaactaagtgtgagcgtcctggaga

SEQ ID NO: 7129 - DNA, 1115 bp, Homo sapiens
gtctatccccttacatcctcctaggacccggtcggtagtcgtcgccccagcccgccgggggcgcagcgcccgagccgcggccctcgagacgggaccgagagcatcatgggcagcactgtcccgcgctccgcctccgtgctgcttctgctgctgctcctgcgccgggccgagcagccctgcggggccgagctcaccttcgagctgccggacaacgccaagcagtgcttccacgaggaggtggagcagggcgtgaagttctccctggattaccaggtcatcactggaggccactacgatgttgactgctatgtggaggacccccaggggaacaccatctacagagaaacgaagaagcagtacgacagcttcacgtaccgggctgaagtcaagggcgtttatcagttttgcttcagtaatgagttttccaccttctctcacaagaccgtctactttgactttcaagtgggcgatgagcctcccattctcccagacatggggaacagggtcacagctctcacccagagattcagaggagcttattggaaggaggtggacaagatggtcgactatatgcagccaggcggaacacctgccaccgagggactgggacgactggcaccctcctaacagattttcagcggggaggcactgagagtggatggagggaagacacagaagctacgctgaagtgggaggaagctgctgcacagagctaccatgcactgggactagctcctggtccccagtgactccaggggaacaggtgagttaaactggcaaggaacaacctgctctcaccacaggcctctggaatcccggcaggaggagactccttgaccaccacagacacttgagctggcagggagagttgcttggagaagtggtaggggcagcacttcagcctgggtggagcccagagggtttggtgtgggagcatttgcaataaagcatagccagggacagccatccctctaggctcgacttgctcccatggcagactttaaccctagggggactgttgaaactaaattcttcagggtggtcttgcctgtcagatgaggccagttcaataacctgagcaccccttggttttctggtctctcctggagccccag

SEQ ID NO: 7130 - DNA, 750 bp, Homo sapiens
cgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggtcagtatggtcttctaataaaataaaaattattaacagccagaggccttactatggtaataagttactgaactaagcattttatctgcattatccaggaaaatctgtttctaatattttatttttgccataaatactttgacctcaagtatcagcttaattttattttatattaatatagcccttttatagttttcaaataacttatcttccaggaccctattataaaaatagcttcagatgtgcaaataagactgcat

SEQ ID NO: 7131 - DNA, 6104 bp, Homo sapiens
gaaccgccgcgggagccgttgggacgcgcctacccggtcactgccccgccccggcgcagactgcgtgaggcgccgccgaaggcgcggggcttgccggggatcgtggtcggcgagcgcgcccgagcccactagcggagcccgcccgggactacatttcccacaattaccgccatgatgcccattggtgggggaagccatgggaaccggaggccgtcagggggagaggcgggcggcgctcacgcctggcctgagggggccgagactgaggcggttgcggaataggactgctagccccgcccagagtccctaccctttggagaactgcgcttctctttcggagggagtgttcgccgccgccgcggccgccacctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattacctaatgatggattgaataaatctttagactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgcctatgaatacccctcccttttgcgctgttaaatttgcaatgagaagcaaatttacagtaccataactaataaagcagggtacagatataaactactgcatcttttctataaaactgtgattaagaattctacctctcctgtatggctgttactgtactgtactctctgactccttacctaacaatgaatttgttacataatcttctacatgtatgatttgtgccactgatcttaaacctatgattcagtaacttcttaccatataaaaacgataattgctttatttggaaaagaatttaggaatactaaggacaattatttttatagacaaagtaaaaagacagatatttaagaggcataaccaaaaaagcaaaacttgtaaacagagtaaaaatctttaatatttctaaagacatactgtttatctgcttcatatgctttttttaatttcactattccatttctaaattaaagttatgctaaattgagtaagctgtttatcacttaacagctcattttgtctttttcaatatacaaattttaaaaatactacaatatttaactaaggcccaaccgatttccataatgtagcagttaccgtgttcacctcacactaaggcctagagtttgctctgatatgcatttggatgattaatgttatgctgttctttcatgtgaatgtcaagacatggagggtgtttgtaattttatggtaaaattaatccttcttacacataatggtgtcttaaaattgacaaaaaatgagcacttacaattgtatgtctcctcaaatgaaaattctttatctgaaattttaaaagacattgattccacatgtaaggatttttcatctgaagtacaataatgcacaatcagtgttgctcaaactgctttatacttataaacagccatcttaaataagcaacgtattgtgagtactgatatgtatataataaaaattatcaaagaaaattaactgccagtcatttgtaaatgctgtctactcctgaaagccttccttcatctctatttagttaataatgtgctctctcctcctgttttgaaaccccatagctctctacacctcttattgtacatcactctactttgcattggagttctgtttctatatgtacttattcacctgttgcctaaacatgcactgttcctaaaaggtacagtttttgctcaaaatatatgaaaggaaagataatcagttcttaaagtttggtatgctaaataagcacccagggaacttacctgctccacctcaccccagaaattgattattcaggtctggaatatggctcaggattcttaattttcaaccaacacaatatagaatcctgtcagttatccttggatcatttgctaagtgatcttgcaaaatcaaaactcctttgagactatttcattttcagaaatattttaaaacttgttcagaaacatcttaaaacttgttagcatataggaaaagtacaatgcttggtgtaggtaggttattatttggtcatttccctcaaaccatccagacaagccactcttctaccacaagctggtagaaatccttaggcacctttctgcttctgcactgctatcactttcaggtgtctaaggcttctggaaggctgttgtcataacctggagccatacacctaatgtacgtctggggaaaggacaccaattaaagaatctagagctaggatgatgttacataagacagggcacaatggagatggactctggatccctgcatctgaaagaaaaaggcaagaaaatgcagggcagggaaaatcctgaaggtcttcactgaccatgaattaaaatcctaattgacagttttacaaacaaaaaccctcgttttagtacttgtgttgtttttgtttctgttttaacaagcttagatttattattgtgccttttatggaagatgaggaagaaataggaaagcagtaaaatgaacaatgagaatctgttacccaaactgatataaactccctcagaaagaaagatactactccctaatcctggaagtgttaagtggcaataatgatcaaatgttgtaaaggggattgttactacagctaatatgaaatgggaggctggactaaatctaacctttctacccttgatttcaattctaaaaggacacgtaataccattgcagaaagaaaagacagttccaaatgataaattttagagttgttttgctaggatgcaagagaaattggataagtggaccactcatacgttgctggtgagatatgaaatagtagagccactgtggaaaatattcttggcagtttcttataaaactaaacatacatttaacatataactggcatttgtactacttgacagttatccctgagaagttaaaacttaacattcacaaatgttacatagcaccttcatttataatagccaaaacccggaaacaacctggatgtccttcaaaaagagtgaatggtttagtatgtccacaccatggaatactaaatagtaatatgaaggaacaaactactgatacatgtaacaaattgcatggacctcaagggaattatgcttgggtggtttggggggacaatcctaaagttttacacactgtatgattctgtttttgtaacattcttaaataataaagctatagagatgggaaacaagattcgtggttgccaggtcttgggactgaagggaaggagaatgtggctataaagggagccttgtggtggaaaagttctgtagtttgattgtggtgattacataaatatacatgtgaaatgttagaagtatttatagctgaaacatattagtatgttggtatatacatatttctgactaattaatttcgccatgttgcccaggctggtctcgaactcctaagctcaagtgatgtgcccgcctcaacttcccaagtgctgagattacaggcgtgagccaccatgtccggcctgttttttcctatgcatgcataattacgatcaagtttaatttgtaattaggcacattaagagattaacaatagctaacaaaatggaacaattacaacaatatattgtaataaaagttatgcaaatgtg

SEQ ID NO: 7132 - DNA, 1296 bp, Homo sapiens
acctggagtttcttcagactccagatttccctgtcaaccacgaggagtccagagaggaaacgcggagcggagacaacagtacctgacgcctctttcagcccgggatcgccccagcagggatgggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaccctattataaaaatagcttcagatgtgcaaataagactgcatcttggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttgtaaatgcggcagttacaaattaactgtggaagttttcagttttaagttataaatcacctgagaattac

SEQ ID NO: 7133 - DNA, 1163 bp, Homo sapiens
ctctttcggagggagtgttcgccgccgccgcggccgccacctggagtttcttcagactccagatttccctgtcaaccacgaggagtccagagaggaaacgcggagcggcgacaagatctggctgcccttccccgtgctccttctggccgctctgcctccggtgctgctgcctggggcggccggcttcacaccttccctcgatagcgacttcacctttacccttcccgccggccagaaggagtgcttctaccagcccatgcccctgaaggcctcgctggagatcgagtaccaagttttagatggagcaggattagatattgatttccatcttgcctctccagaaggcaaaaccttagtttttgaacaaagaaaatcagatggagttcacactgtagagactgaagttggtgattacatgttctgctttgacaatacattcagcaccatttctgagaaggtgattttctttgaattaatcctggataatatgggagaacaggcacaagaacaagaagattggaagaaatatattactggcacagatatattggatatgaaactggaagacatcctggaatccatcaacagcatcaagtccagactaagcaaaagtgggcacatacaaactctgcttagagcatttgaagctcgtgatcgaaacatacaagaaagcaactttgatagagtcaatttctggtctatggttaatttagtggtcatggtggtggtgtcagccattcaagtttatatgctgaagagtctgtttgaagataagaggaaaagtagaacttaaaactccaaactagagtacgtaacattgaaaaatgaggcataaaaatgcaataaactgttacagtcaagaccattaatggtcttctccaaaatattttgagatataaaagtaggaaacaggtataattttaatgtgaaaattaagtcttcactttctgtgcaagtaatcctgctgatccagttgtacttaagtgtgtaacaggaatattttgcagaatataggtttaactgaatgaagccatattaataactgcattttcctaactttgaaaaattttgcaaatgtcttaggtgatttaaataaatgagtattgggcctaattgcaacaccagtctgtttttaacaggttctattacccagaacttttttg

SEQ ID NO: 7134 - DNA, 938 bp, Homo sapiens
cttgatttccctgggctgcgagcagttcacctgcagaggaggctccagaaagcggcatgtcccctttgctctttggggctgggctggtcgttctgaatctagtgacgtctgccaggagccagaagacagaacctctaagtggctctggggaccagccactcttccgtggagctgatcgatatgactttgccatcatgatacctccaggaggcacggaatgcttttggcaatttgcccaccagactggatacttctatttcagttacgaggttcagcggacagtggggatgtcacatgaccggcatgttgctgccacggcacataacccacagggatttctcatagacacctcccagggtgttcggggccagattaacttctctacccaagagacaggtttttatcagctttgtctaagtaatcagcataatcacttcggttctgtgcaagtgtacctcaactttggggtcttctatgaggggcctgagactgatcacaaacagaaggaaagaaaacaactgaatgatactctggatgcaattgaggacggcacacaaaaggtgcagaacaatatctttcacatgtggcgatactacaactttgcccggatgaggaaaatggctgactttttccttatccaatcaaactataactacgtgaactggtggtcgacagcccagagccttgttattattctttctgggatcctgcaactgtatttcttgaagcgtctcttcaatgttccaacaactacagatacaaagaagccaagatgctaagctaaggtgactatagcaccctggctgttttcttctggggcttagtcgaatcagctttgtaatgttatgggacaaaaatcaattatctcattaatgttttagtctgctgcacacatctaaaaaagcaaaatggcaataaaatcataacagtgaaaaagt

SEQ ID NO: 7135 - DNA, 3757 bp, Homo sapiens
cccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatggtaaagtgttatacaaagagatgaagaaacagtatgatagttttaccttcacagcctccaaaaatgggacatacaaattttgcttcagcaatgaattttctactttcacacataaaactgtatattttgattttcaagttggagaagacccacctttgtttcctagtgagaaccgagtcagtgctcttacccagatggaatctgcctgtgtttcaattcacgaagctctgaagtctgtcatcgattatcagactcatttccgtttaagagaagctcaaggccgaagccgagcagaggatctaaatacaagagtggcctattggtcagtaggagaagccctcattcttctggtggttagcatagggcaggtatttcttttgaaaagctttttctcagataaaagaaccaccacaactcgtgttggatcataactacgttttgagaattgatgcaccattgccactgtaatattgctgtcctctaattaattttaggtactgaagaacttaatattggcaacatttttaaatccttactcatacacttgttgggagggatgtacaatgcatattcccaaactgtggaaaggacacctttttttatttgtaaaggtggaaaaactttggaactcattttgggctattcatgttaaatattcaacaccaatgatctactctgttcgcagttgtttatatctactcttcgcacactaaactttggtattttgattccttttaaccatttaagactacttttcttataggtagttgatattttaaaaactttagatttaatgtctacatgtgttagggaggaagaaaattgccttttaattgttaataagaaaaccaaatgtgatgaactgtagcccaagccctattctgcactgttcagttttatggaggaaaaataaatctaccataggaatgttagttaatattgatatatcatggtaaaattgatttctcactagcttagaaaatgtcagacttttgtttttggggtttataatttaaaccagctatgctattttttcataaaggcatttgtagtacacagaaaacagtagtttcagtagtgtaaaagagtttatacaggccttaaatatcagactttgtaacaggtagaaatattacagaataatttaagacactacaatgggggcaaatgaaataggaaaatttttagtgagttacacgtactcattacattttcagtgcttttacaaggaaaaaaggtgatatgtttaattttaaaattttaattggctagctcttgcccttatatgactttaatgtctgtgagtcattcccagcttaaattaacaattgttagtattagtctcacacataagtgccatacattttatcctcatggatgtgatgcactgaaaagttagttgctctccttttttcttttttttgtcgtgcatattttatttctgtagtttctggttagctaccctaaagtgatttaaaaatttagaatgctttgtgtttcctatttggtaatcttcattgacttttctttagttaatgagtattaaatagtgcatattctgtagactatagggtttacattgtgttgcatcttataacttgtatagattgagctgattgaaataagattttgttccaagtattatctgatagaatacaagatgattcaaaattatatagatatttaaagcttttctgctgttttttttttttttaattgcaactgcttttctgccgtgcctctcttccctacccaaaagtgatgagttctgaacaagacaagactgtcatattgtagagactttggtatgtgataccatagaatactgattggatagccatcctagtcacttaccaatactgactagaagttaactcttaattctaagctatcttaaaatgcatatatatacttcttgcatggaagagcaaaacaaattcaagttgtcatgcctgataatttcagatgccaccgtatagcaaagggtgaacatgttttcaaccctttaactttttacggtgtttgaagaccagctactccttaatatttatcaatggattaagaagtttaagattttgcagatttatcaatttgggtttttgtactgaagttgtcttgcggctttgcaagtgtccctttatatttaaatttgaaagttgtaagcactgatgttaatgtgattgatcagcatgggcatatgtaaaatgtccttttctggttgcctctctatgctattgtgttcagatacttacaccataattaaacagtaagttatagacttgctgagtttggcatagatagtgcactcatttaatctgtgcctctcaaaacttcagaatattagcatattaccacaaataatttttggtgaaactattgagatattaaaatttttgaaatcactactgttacctgttatagaaaatagtgttggcttagtctagtctctgtgtaactggttacattttgatggttgtctatactcaactggatatgtgtatgtaaattagaaaatacatacctatccagacataaatgctaagtaacatttttttcttcctccaactacataatttgtagctcatcatttttccttaatcctttcctaacttgttgcagcagtttgaatttcccagatatttatgtttgaacataatggctcagaatacatatttgaacatcatagttgtatatatttttaaagtagaataaataatggaaagcaacttgatatacaagtttatactaaaatttcaactgtgtgaagatacattttaaggcattactttgctaataatctacacattcttttttctattaaataaacaaatggtttgtggttcacagctttcatccaagcttggtgataatcaattttgaaaatacagtggactgaaaagcaaatttattctttcgaagatttcatttaaatctctgtactatgcatttttgtttcagtttgtaaatgtgtaacatttatagttaaataggacaaagcaggccctatgactattgttttcaaaaaattaatatataaataattcagaggggtttttcatttacttttgaaaagaaatttctttaacaggattgcacctatcaatttcttgtagaataaaaaaaaatctttca

SEQ ID NO: 7136 - DNA, 572 bp, Homo sapiens
attaggaacttcatagctgcaagctaagggaatgctatccatcctgaaggattgcctattcaacaaaaggcaattggggtttgtcttattgctgcaggccttgcttctcagtcactgactgactgttgagagccaaggtccgcccgtctgcgcccctcacaggaagccggagggtcgctctgatcccgaatctcccacaggcgtgaacctgctctgctgtgtatctttgcggggtggcctgcgctgaggcctgccgcgcgcggtgagtccgcgcagacctgaccctgcgtctcgcagctcggttgaggccgccgccgccttctcgggatgccgcggccggggtccgcgcagcgctgggcggccgtcgcgggccgttgggggtgcaggctgctcgcactgctgctactggtgcctggacccggcggcgcctctgagatcaccttcgagcttcctgacaacgccaagcagtgcttctacgaggacatcgctcagggcaccaagtgcaccctggagttccaggtgattactggtggtcactatgatgtagattgtcgattagaagatcctgatgg

SEQ ID NO: 7137 - DNA, 7784 bp, Homo sapiens
gctgtttccggagccactcgcggctggcagcggagagctccgtgcgcgggctgcagatgtctgacctgcaggcggctgaggggccgggctcctggagccccacagcccgcccagggtcggctggcggcgtcggggactgccagggagtggaggggagccaggcggccgcctcagagaatgaagatctagaaaacaaggatacctctttattggcttctgccaccgatccagaaccctgctcctcaccccacaggccacagatggtatctccagtgagtaaggatgccacggaagatctgcggaaagcaactggtcctttggaggctcaggccttggtgaaacaggatttgctgcctgcagaccaggcccaggtcctcaatgagatggctaagtatcaagttccacagaggtctggggacatcgttatgatccagtctgaacatacaggagctatagatgttctttcagctgatttggaatctgcagatcttctgggggaccacaggaaagtctccccacctctgatggctcctccatgcatctggacctttgccaaggtgaaggaattcaaaagcaagctgggcaaagagaagaacagccgtctggtggtgaagcgtggtgaggtggtgaccatccgggtacctactcatccagaggggaagcgtgtctgctgggagtttgcgaccgatgactatgacattggctttggagtttattttgactggacccctgtaactagcactgacataactgtgcaggtcagtgattccagtgacgatgaggatgaagaagaggaagaggaggaagagattgaagaacccgttccagctggagatgtggagagaggctccaggagctccttgcggggtcgctatggggaggtcatgcctgtgtaccggcgggacagccaccgagacgtgcaggctggcagccatgactaccctggtgagggcatctacctgctcaagttcgacaactcctactccctgctgcgcaacaagactctctacttccacatctactacaccagctgaaggactgctgggacaggggcaggctgtatttgctggctgaagcaggctgccagctggtgcctcttgtttgggataggcaagagccaaaggttcatggggggctgctgagcctcacaccctgtctggcatgcctgactgttggcccacgtagctttttccccttcttggcttctgcaggtggtggtgtagtgcccctgttctgtagtccctgactcatacccttcttgcttcagactccagcaaattccctcttgaaggcacctatggggcacaagcctaaaaggaagcagggcgatgttttttaaaaatagattcatcttggcacaggtttatcattcagattgctgccctctcctctcccacagcccttattgccagtgcatttagtggcacccactctcttcagttgttgaggtgccagaagagggaaaagcacattgcccatgaaggagccccatcttttggttggagaaagctctatccagcctgtcaccactgccatattcctgcctgctggttattcttggtctctgcatagctgggagaccacactgcctttggagggctattactattcctgatggtagacaccccctcctttctctttcctaagtctatgtttttgccattacagcaagaacattcatgcaatctcaagtgatgatcaatgtaacctaagatcttgtgggaagaaaaactgcccccattatttcctattccaagagctggtttcccttactatgggcactggcagtcaaagtggagagagtggaaattaggtactgaattgatgtcagaacccacatatttgaaagtcgtgttacttttttttttttttttggtataatcaaagaaggaatggtatcatctgacagagaagatgaaaaacaaaaaacactccagagtccccaccgcttttttttgtctttagagtaggagtgctgtttagaaatgttgctttggaatcaaatgcagtgaaacccaatcaggtttccaaagtttctgcatttagctttcttgcattgagggcttaaagcttttggtgttcaaagtcccttagtttaggtgataatgaagcttcactattgctgctgattgtatttgttctttacctgaccaaagcttgcatttccctggtgacagcatttcctactgtgtcacccctgaggctcaggagtgccacagagtgcaggtagtgctgcagccagtggtcaccagagcaccagctgctgggcccccaggcggaggaggagacggaggtgagatgggacctcagcagtctctgtgtttgtacctccctgtctcttactcctcgtgttatgtctgttactgcctacgaattctgaagaataattagatttatttattactgtatttatttttttagcacatttcattttgcctttgaaacagtttccatctgtttctcagaaggcttcccatctgttctgagccactgaagccccctcttttatggagttaaagatgatatttttaggagaatttgggaagcgatgatgttttatttctgtaggtcagtcctgtgacggctttgcgaggagtatggcccttcagagatggatgatgccaccttactccatgtttggggtacagtccagcactccccatgaaaaattctaagttgtgagggaatctgcccatttgctggagattgagtgcagaggaattccctaaccaatcagagatatcccgtgattccaggatttcagagtcctttgtctcctctgaggtgtcaccttctttgtgatgtttcctttgactcattgttagattcctcacaccaagggtctatccctacagtagcataactcaaggaacgggactcttcccagtgggtccctagtagcatctacatcacatcaaagggcaatatatcctgcacctgctcttcccctcggagcaaagccccaagtgggataggatgttggggactgccagagcattcccattctctgagcagcatcatacctccattattttatatttgcaaatgtgttttgtagaggattacactggccaacatttatatacctttaaagaaattattttagtgactgtctgttgaggcagtgaagagctgatttgctgtgtgtcatcccattggatagctgagtgaccgctcttgcatcattgaagttgaatcatgccttagctaactgaatataatctttgtaaaataattttctactgagctgttttctagtcagctaaagccttgcttatttttcctgtttattattaacttctgcctttctctcaaattgaaacagtcaggccatacacagcaagctcccaaggataacacttgttattatttattttcaccatgagattctctgcttattttctttggaatcctagttctgttgcatcagggaagcctaagggacttgttcccctcacctctgtgtgcctcttagggtctggtcacttttgaagtcctgggcatggttacatttcattcatactggtttttcaccaactgtcagggtttctgtgttccattagcacaaaatagctaaaagaagatattttcactgtctaattcactattttcatgttacatttctgaaataattgaactttaggggcaagatactacttactgaagcacaggtaattactgagaacccacagcccagcaaattctaagagacagtcatttcctcagcccctcccagtccaaatttatagacccaaacaatgaaatgaaaaccgtttgctttgatcctcaccctgttctctagagcacaaacaaatagtaacaaacaattgaaagaaagtgcttcatagtaggagagagattggaattctctatagtgactgagttcttaaatttctttagttttagttttgccactttgttgagagatgggccttttagaaaggaagacatatttaaagtattgatttcttttcccccagtgttttattgtgaaaaaatttcagcaaacagcttaaaagaaatataaatatattgtaaaccaaaaagtatctgagacaggtctcaatacatttagaggtttattttgccaaggttcagagcccatgatggggcctcaggaggttcttagaacatgtgcccgaggtagtcgggttacagttttatacatttgagggagacagaaggtccaggcaaagccataaatcaatacatgtaaggtatacactggtttggcctggaaaggcaggacatcttgaagatgggggtttccaggtcagaggtagatcaaagagttcctgactggcagttggttgagagagttaaactttacctgaaaagatgaagtcagcttaagttaaagtaagggaggcttggcttaagtcatgtagatgaagcctccaggtagcaggcttcagagagaacagatgatgaatttttctttttaggccttaaaaggtgtcagactctccagaaaagacctaataagagaaggagattctctacagaatgcagtttcccccacaagagacagctttgtagggccatttcaaaatacgtcaaataaatatattggggggtaaatttcctttggggcctgctgtcatgtgatgctataccagagtcaggttgggatttggtattttattgccacaaagggtctgtttggttagtcttaagatctctgttttaatgttaatgctggtcagttgtatttaaattccaaagggaagagggtaatatgaggcaccctgtaatctgaccataatatgaggcaccctgtcttcccatcatggactagtttttcaggttcctttgagatcccctgggccaagacaggggtccattcagccggttgggggatttagaatttatttttggtttgctgtatatatatgtatacacacactccccgcataaatgtaaaaattttaaactaccaattcctaggcaaagatgattctaacattctgttccttttgacaagtgtccaattagagaatgctgagaatgtcccctgcatatcggctctgttggagagcccctgatttttagcagacctgtttcattcaacatgggttacccaggaggtggtcttcataaaaatgtttcttggaggccaggcgccgtggcccacgcctgtaatcccagcactttgggaggccaaggtgggcagaccaccttaggccaggagttcgagaccagcctggccaacatagtgaaactccgtcgctactaaaaatacaaaaaattagctgggcgtggtggcgggcatctgtaatcccagctactctggaggcagaagcagggagaatttcttgagcccaggaggcagaggttgcagcgagccgagatcatgccactgcactccagactgggcaacagagcaagattccgtctcaaaaaaaaaaaaattgtttcttggtctccatctttcaagaaaatacatctgtgctgtattttccccttccctcaggccatgatctctgctgttttccttactaactggcatgtcagtacaagagtgattgtgaagctgctccggaagggctttatgctaacctctgttgcttgatgacatgtcctcaggactctgatattaaaactcaatccttagataacaggtagctttatcatggaagtaggtagcaatttggaattagaccattcttagttatttttttcttaatgaattgatacatgcactttaaaaaatatttttgttattttgggaagaaaaactcagacttttaaaaaagtgtatattgtcccattataatatgtatatggaagagtgaaatctgaacgctgtcttatattaagcagtagaattaggtattatcataaaaagtcttaatctgtagggaatatgagtttatgtttatgagtcctgctcagtccctctttgagagaattagttgaaacccagactctaaagtctgcttttatatttgtttgttaagaccacttatctgcagaaggttgccttttaaccccagtggttctaaggtgtggaattgagtgaccctaatatttacataagagacttgttttagtggagcataagggaggggcataagttacaccgttttgtgctgcttgagaactgtcttttaaaattgatcacaacgagggaaaacaaaataaaattagggggcaaagggtaggagtatggggggaggggagagcaaacctatcgaatatatcttagaattttgctcagaaatcactgctgcctctcaagtgttgcattgtccctgcctaaaccaagaaggctaaacaaagcccctcctgtttgaattcttaaggtaagaaatttctaagctaagaaaacactattgcctaaaaccaatgatagtggagctcatttacaaataggcatgcctcacacacacagtccaaaggcaagacactggctttgaaattaggctcatgatgtgattcctattatatgtacctgatttttttaggccccaggtatgtggaccagagttaatgtcatgactcttcaaagatatgatgaaaagttgccctagaaatctagagatgcatgtttatttaattccatagtttaaaaaaaaatttaagcaggtagttgtggcttatctgggggcaaaataatatatgtgaaattgcttccagaggacaaagtatattttctaaagtcctgaaataggatcatgaacccttctgaagttttggtttgaaatattatagtatatgatattaccaaagagcccttaattcagagtttaaggggctctcttcctgaactctcttcatcactcagggttgaatgtgtaatgttccttgctattgattgttattgttgattcttaggatcaggccaagaatcatctggaaaacattatcttaattccgtctctcatatcctaaacagtacattttactaagaaattccatatgaaaaactccactcatgtctcctgagattatcctgtaagtgaagtagctttcatttaaccaagctaaattatttccatttagccatgttaaagagaagccaagtctagagaaagcaatcctgtaacccatgaatctggtgtacccattttcccttaacgtaacgggaagtgttttgaaattcccagaagagagctgttttgtaatcaaagtgatggattataagaaagccagactttggaaaaggataattggaataaagggaggtgcttgaagattttccaaactactttatgtcatttagcttctattttctgaagggctttctttggtgccatgtactcagatcagtcagttgactgaaagatgatcatgttttcttcgtaaagatttaagcaattggcaactacaaagacattattttcttactgttctatatcatgtactgttgctgacattacaaaaagggtctggaagggaaaccgtgtcactgttttatcttttttctttaaaatacaaaagtatcccaactaatcatttattatggtcagcttgttttacatgtcccctatcatgagaaatgctatcaacatctgtgatttctaagagtcttaccaaattgttactttaattcttgtgtcctgctgagtggtttttcttttaaaataccatttttatcaccctgtggcactgggtgtgttactgcgattacactgatgattctgagctgtgcttcttcaagtagctcagttcttgcgttttatattaggtaacagttttgtgatgcttttgtgcattctttgtcatctcttctgagttttcgaatctgtcataaataaactttttcactatgcacctggtaa

SEQ ID NO: 7138 - DNA, 1473 bp, Homo sapiens
gcggcggcagggcgacgtggcgcggccggctgcggctgcgcaggcaggtggagcaagatggctgtggagctgggcgtgctgctcgtccggccccggcccggaaccgggctgggtagagtgatgcggaccctcctgctggtgctgtggctggcgacgcgcggaagcgcgctctactttcacatcggagagacggagaagaagtgctttattgaggagatcccggacgagaccatggtcataggaaactaccggacgcagctgtatgacaagcagcgggaggagtaccagccggccaccccggggcttggcatgtttgtggaggtgaaggacccagaggacaaggtcatcctggcccggcagtatggctccgagggcaggttcactttcacttcccatacccctggtgagcaccagatctgtcttcactccaattccaccaagttctccctctttgctggaggcatgctgagagttcacctggacatccaggtaggtgaacatgccaatgactatgcagaaattgctgctaaagacaagttgagtgagttgcagctacgagtgcgacagctggtggaacaagtggagcagatccagaaagagcagaactaccagcggtggcgagaggagcgcttccggcagaccagtgagagcaccaaccagcgggtgctgtggtggtccattctgcagaccctcatcctcgtggccatcggtgtctggcagatgcggcacctcaagagcttctttgaagccaagaagcttgtgtagctgtcccaggcgtcacaacccatcctcccaggctgggggagaaaggacctcctggaactgacttcttctgtcaggaggactggtttccagccatacctgttctggaagggagaggggctggaggcacccacaggcacaagctgaaggcagcagcttggctaatactgagcaggtagtggggcaaattcctgccctctctctctggcctctgggccgtttggtagtaatcacccaagggctggtaaagcccctcctcttggcacctcagaatcacagtgttactgatcagggatgtgaggctgctgttgggggtggggggaggggaatgggcaggcaagccagtcttctgtcttcctttgctaacttagggttttgagcaggttggggtatggtgcctgtcatacccacctgccaccctgggaacctcactgttctctctttcagcctagacctgctgatccagggtgtgtgtgagttgagggtgggtggaggggtttgcagtgtgggaatgtggccctgcagttgacctgagctgcttcacatggttgtccattctggggcttaaagaactgggaccagaccaagtagaggccttggtgctggttggggtggggcctgcagagtcttagttactgatttcattttcaataaatgtaggtttgttacatgagtttcccaataaaaaaaaaaatgacttcttgtccagtg

SEQ ID NO: 7139 - DNA, 2500 bp, Homo sapiens
gtcctgagtattgctcttcacgcttcagtcggacaggcctgtattccatgggaaagtccattggccatttttaactggggctatttcttttctcttatggactatatcaggccacagtggtctccaagggcatgatactcaaaggttgtctcctgtatcctttgtgctctcccaggaataagcaaagatgtgccaggctgtggaaaatagcctatggaggattactaaagatagtgactggctccctcttaacattttatgtggttctctgtcttgatggcgggatggtgctcatgaggaagcaagtgccatcaaggttcatgtaccccaaagagtggcagcacctcaccatgttcatcctcctcactcttaatggctgtgtggacttcatgagcaagaatgtgctgcctcagaggtgtgtgggcctagaaaaaggtaccctggtcctgatcatctacgagctcctgctgctgatggtgtcacatgttaaagattcagaaggggtggagctgcacgtttattctctgctcatcttggtggtgttcctgctgttgctggtgttgactgcagagctgtgggctcccaacatgtgtcatctccagctgatggagacctttctgattctgatgatgggctcctggctgatgcaggcaggctttattctatacagacccgtctctggctacccatggcaggacgatgacatcagtgacatcatgtttgtcaccaccttcttctgctggcatgtgatgatcaatgcctcattcctgttgggaatctatggcttctcttccttttggtatcattgtttcagacccagcttgaagctgactgggcccaaagaagctccatattatgcaagcactccaggacccctctacaagttgctacaggaagtggagcagtcagagaaagaggaccaggctctcctccttccaaagagctccccctgagacagggcctacagtggctggcacatcgtccacctcatcttcctcctgttggctcctcagccacgagcatggtaccctccttggtaaaggtaatggccttgaaggctagcagttggtcccgtctgctggttcattttcttttcttctcttttctttttttttttttttgagacagagtctcgctctgttgcccagcctggagtgcaatggcacaatctcagctcagtgcaacctccgcctcccgagttcaagcgattctcctgcctcagcctcccgagtagctgcaattacaggagcctgccaccatgcccgtgctggtgcattttctgtccctgagcctctaattactgagaagataaggggagagggattgagaaagagacgctgatgggatttgcgggagggagggaaaaggacgaggagaacacttcttcttagtgtgcaagaaaagccactgggggaagagaatgcaacaaaaggaagagctgtgaagggaggagaacagagtctagcagttatgctgtcattagcgtcatcaggcacaagggattgccttttacctgagggaataaagacttctcacaactcaaaactggacccattcaaatctcatcttgataaagaaaagtgggtactttacgtgctcaccaaagtggtgccaccatgtggaaatagcatgatagaatttataattaattcatacaggctgaaattatgctcgctttgcctccttctctctccgcagctttcaagaattggcttcatttcaaactttacatataaagtgagactttttaaatacttaataacatttcaaatttccataatttaaatttgtatagaattcaactgctatagcatttttatagcattcaaatgcttggtacttccctgacttctcattttattactcttattctagcccaaactttccttttcaccatgaccacccttgcacatgcaatttagcagataccattcttgggtctttgcaaatttcttttccttgcaaatcacagccagtcatcctacagtcacatatttaccatgttattcgattcccagaataaacctacatccacccccacaccgcaccaagtatccccaaggtggccttctccagaactcttactgattcccttgttttggaactcttgggcacttacattaaatctgctttgttagtttgctcatacaggtgacccactttcttttatactgctgctgaaatcattttctttcagaaggttcttcctcacccactaaagtacaggctcctaaagggaaaagactttgccttatccaagttaccaaatttcctatgtatactccagctatggatcatggttatgtttaataaagccttctttgcttccagagtcttccctaatcctgtttcttctaaatgtattgctggacaggttggaggttttgtgaatctctctgggtgacaacaacagtcctgaacactgagtcactgccttagtaatgcacccactctcttccttgttttggggtataataaaatccagtaacttgtttctgaa

SEQ ID NO: 7140 - DNA, 1562 bp, Homo sapiens
agtccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatag

SEQ ID NO: 7141 - DNA, 1633 bp, Homo sapiens
atgaatactagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaagggagacagcagtatttttctgacttatttaacattttagatactgccattattgtgattcctctgctggttgatgtcatttacattttttttgacattaagttgcttaggaatattcccagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgagagcagagaagagggcagcacacagggccaactggaagggggagccatccaggagacctgtgctcgactgatgggtgggagcaatagcgagagagagggagggacctgagagtggaagcctttattgggataatcttcctaaatactatgacaattgtccatttttcttctggttcaacacgtcttttattcaaaataacaggctttgtctaccaagaaatgaattggataatccac

SEQ ID NO: 7142 - DNA, 1670 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacagacaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatga

SEQ ID NO: 7143 - DNA, 1790 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacagacaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaagggagacagcagtatttttctgacttatttaacattttagatactgccattattgtgattcctctgctggttgatgtcatttacattttttttgacattaagttgcttaggaatattcccagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatga

SEQ ID NO: 7144 - DNA, 1558 bp, Homo sapiens
atgatcgaagcagtacaaatcaggggagaacgtgcccaagacctggagaactgataataaattgtggtttatccttgcaatggaacactatatggaagtgaaaatgattgaaatagagctatacacatcatcacagacaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaaggatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatga

SEQ ID NO: 7145 - DNA, 1652 bp, Homo sapiens
agaccaaattggataaaagaggacgaagtcatgaaagggatgcttcttcctcttagtatatttgtcactctaagttggtggtatccaatcccttaggaacgaacctctgaggttttccatttatgagactctcctactactagagtgggccaaagggagagagaatcctatttggagcaatgaggaggtaacagtccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgaatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatag

SEQ ID NO: 7146 - DNA, 1793 bp, Homo sapiens
agtccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgacagcaagattaagaaaattgtgcattcaattgtatcatcctttgcatttggaatatttggagttttcctggtcttactggatgtcactctcctccttgccgacctaattttcactgacagcaaactttatattcctttggagtatcgttctatttctctagctattggcttattttttctcatggatgttcttcttcgagtatttgtagaagggagacagcagtatttttctgacttatttaacattttagatactgccattattgtgattcctctgctggttgatgtcatttacattttttttgacattaagttgcttaggaatattcccagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatgatgttgtagctggatccgactaagtatagctcccccttccccttctgggaaagaattatgttctttccaacccctgccacatgttcatgtgtcctaagtcttccttgatgatgcatctatatttatatatgtttatatatgttcttcataaatctattaaatatatatag

SEQ ID NO: 7147 - DNA, 1186 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacagacaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgagagaagagggcagcacaagggccaactggaagggggagccatccaggagacctgtgctcgactga

SEQ ID NO: 7148 - DNA, 1457 bp, Homo sapiens
aatgatcgaagcagtacaaatcaggggagaacgtgcccaagacctggagaactgataataaattgtggtttatccttgcaatggaacactatatggaagtgaaaatgattgaaatagagctatacacatcatcacagacaaatttcagaaacaacgctgagtgaaaaatccacccacaaatgaattatcaggagtgaacccagaggcacgtatgaatgaaagtccacagacaaacgaatttaaaggaacaaccgaggaggcacctgcgaaagaaagcccacacacaagtgaatttaaaggagcagccctggtgtcacctatcagtaaaagtatgttagaacgactttccaagtttgaagttgaagatgctgaaaatgttgcttcatatgaatggacacatttagttcgacttctacgacttattattctgataagaatttttcatctgcttcatcaaaaaagacaacttgaaaagctgatgagaaggctggtttcagaaaacaaaaggcgatacacaagggatggatttgacctagacctcacttacgttacagaacgtattattgctatgtcatttccatcttctggaaggcagtctttctatagaaatccaattgaggaagttgtgcggtttctagataagaaacatcgaaaccactatcgagtctacaatctatgcagtgaaagagcttatgatcctaagcacttccataatagggtcagtagaatcatgattgatgatcataatgtccccactctacatgagatggtggttttcaccaaggaagtaaatgagtggatggctcaagatcttgaaaacatcgtagcgattcactgtaaaggaggcaaaggaagaaccgggactatggtttgtgccctccttattgcctccgaaatatttttaactgccgaggaaagcctatattattttggagaaaggcgaaccaataaaacccacagcaataaatttcagggagtagaaactccttctcagaatagatatgttggatattttgcacaagtgaaacatctctacaactggaatctccctccaagacggatactctttataaaaagattcattatttattcgattcgtggtgatgtatgtgatctaaaagtccaagtagtaatggagaaaaaggttgtcttttccagtacttcattaggaaattgttcgatattgcatgacattgaaacagacaaaatattaattaatgtatatgacggtccacctctgtatgatgatgtgaaagtgcagtttttctcttcgaatcttcctaaatactatgacaattgtccatttttcttctggttcaacacgtcttttattcaaaataacaggctttgtctaccaagaaatgaattggataatccacataaacaaaaagcatggaaaatttatccaccagaatttgctgtggagatactttttggcgagaaatgacttccaatga

SEQ ID NO: 7149 - DNA, 2817 bp, Homo sapiens
actatagatcacacgtaatacatgagagtcattcatttgagtgggaatctcaaagcagttgagtaggcagaaaaaagaacctcttcattaaggattaaaatgtataggccagcacgtgtaacttcgacttcaagatttctgaatccatatgtagtatgtttcattgtcgtcgcaggggtagtgatcctggcagtcaccatagctctacttgtttactttttagcttttgatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgcaaaggaaaaagtgatagaataatattcaagacaaaaagaacagtatgaggcaagagaaataatatgtatttaaaatttttggttactcaatatcttatacttagtatgagtcctaaaattaaaaatgtgaaactgttgtactatacgtataacctaaccttaattattctgtaagaacatgcttccataggaaatagtggataattttcagctatttaaggcaaaagctaaaatagttcactcctcaactgagacccaaagaattatagatatttttcatgatgacccatgaaaaatatcactcatctacataaaggagagactatatctattttatagagaagctaagaaatatacctacacaaacttgtcaggtgctttacaactacatagtactttttaacaacaaaataataattttaagaatgaaaaatttaatcatcgggaagaacgtcccactacagacttcctatcactggcagttatatttttgagcgtaaaagggtcgtcaaacgctaaatctaagtaacgaattgaaagtttaaagagggggaagagttggtttgcaaaggaaaagtttaaatagcttaatatcaatagaatgatcctgaagacagaaaaaactttgtcactcttcctctctcattttctttctctctctctccccttctcatacacatgcctcccccaccaaagaatataatgtaaattaaatccactaaaatgtaatggcatgaaaatctctgtagtctgaatcactaatattcctgagtttttatgagctcctagtacagctaaagtttgcctatgcatgatcatctatgcgtcagagcttcctccttctacaagctaactccctgcatctgggcatcaggactgctccatacatttgctgaaaacttcttgtatttcctgatgtaaaattgtgcaaacacctacaataaagccatctacttttagggaaagggagttgaaaatgcaaccaactcttggcgaactgtacaaacaaatctttgctatactttatttcaaataaattctttttaaaataa

SEQ ID NO: 7150 - DNA, 1592 bp, Homo sapiens
aaagcagttgagtaggcagaaaaaagaacctcttcattaaggattaaaatgtatagatcaaaaatcttacttttataggagcagttttcaactcctaaatgttgaatataatagtcagttaaattcaccagctacacaggaatacaggactttgagtggaagaattgaatctctgattactaaaacattcaaagaatcaaatttaagaaatcagttcatcagagctcatgttgccaaactgaggcaagatggtagtggtgtgagagcggatgttgtcatgaaatttcaattcactagaaataacaatggagcatcaatgaaaagcagaattgagtctgttttacgacaaatgctgaataactctggaaacctggaaataaacccttcaactgagataacatcacttactgaccaggctgcagcaaattggcttattaatgaatgtggggccggtccagacctaataacattgtctgagcagagaatccttggaggcactgaggctgaggagggaagctggccgtggcaagtcagtctgcggctcaataatgcccaccactgtggaggcagcctgatcaataacatgtggatcctgacagcagctcactgcttcagaagcaactctaatcctcgtgactggattgccacgtctggtatttccacaacatttcctaaactaagaatgagagtaagaaatattttaattcataacaattataaatctgcaactcatgaaaatgacattgcacttgtgagacttgagaacagtgtcacctttaccaaagatatccatagtgtgtgtctcccagctgctacccagaatattccacctggctctactgcttatgtaacaggatggggcgctcaagaatatgctggccacacagttccagagctaaggcaaggacaggtcagaataataagtaatgatgtatgtaatgcaccacatagttataatggagccatcttgtctggaatgctgtgtgctggagtacctcaaggtggagtggacgcatgtcagggtgactctggtggcccactagtacaagaagactcacggcggctttggtttattgtggggatagtaagctggggagatcagtgtggcctgccggataagccaggagtgtatactcgagtgacagcctaccttgactggattaggcaacaaactgggatctagtgcaacaagtgcatccctgttgcaaagtctgtatgcaggtgtgcctgtcttaaattccaaagctttacatttcaactgaaaaagaaactagaaatgtcctaatttaacatcttgttacataaatatggtttaacaaacactgtttaacctttctttattattaaaggttttctattttctccagagaactatatgaatgttgcatagtactgtggctgtgtaacagaagaaacacactaaactaattacaaagttaacaatttcattacagttgtgctaaatgcccgtagtgagaagaacaggaaccttgagcatgtatagtagaggaacctgcacaggtctgatgggtcagaggggtcttctctgggtttcactgaggatgagaagtaagcaaactgtggaaacatgc

SEQ ID NO: 7151 - DNA, 3947 bp, Homo sapiens
cagttcttaaattagcaagccttcaaaaccaaaaatggggtcgaaaagaggcatatcttctaggcatcattctctcagctcctatgaaatcatgtttgcagctctctttgccatattggtagtgctctgtgctggattaattgcagtatcctgcctgacaatcaaggaatcccaacgaggtgcagcacttggacagagtcatgaagccagagcgacatttaaaataacatccggagttacatataatcctaatttgcaagacaaactctcagtggatttcaaagttcttgcttttgaccttcagcaaatgatagatgagatctttctatcaagcaatctgaagaatgaatataagaactcaagagttttacaatttgaaaatggcagcattatagtcgtatttgaccttttctttgcccagtgggtgtcagatgaaaatgtaaaagaagaactgattcaaggccttgaagcaaataaatccagccaactggtcactttccatattgatttgaacagcgttgatatcctagacaagctaacaaccaccagtcatctggcaactccaggaaatgtctcaatagagtgcctgcctggttcaagtccttgtactgatgctctaacgtgtataaaagctgatttattttgtgatggagaagtaaactgtccagatggttctgacgaagacaataaaatgtgtgccacagtttgtgatggaagatttttgttaactggatcatctgggtctttccaggctactcattatccaaaaccttctgaaacaagtgttgtctgccagtggatcatacgtgtaaaccaaggactttccattaaactgagcttcgatgattttaatacatattatacagatatattagatatttatgaaggtgtaggatcaagcaagattttaagagcttctatttgggaaactaatcctggcacaataagaattttttccaaccaagttactgccacctttcttatagaatctgatgaaagtgattatgttggctttaatgcaacatatactgcatttaacagcagtgagcttaataattatgagaaaattaattgtaactttgaggatggcttttgtttctgggtccaggatctaaatgatgataatgaatgggaaaggattcagggaagcaccttttctccttttactggacccaattttgaccacacttttggcaatgcttcaggattttacatttctaccccaactggaccaggagggagacaagaacgagtggggcttttaagcctccctttggaccccactttggagccagcttgccttagtttctggtatcatatgtatggtgaaaatgtccataaattaagcattaatatcagcaatgaccaaaatatggagaagacagttttccaaaaggaaggaaattatggagacaattggaattatggacaagtaaccctaaatgaaacagttaaatttaaggttgcttttaatgcttttaaaaacaagatcctgagtgatattgcgttggatgacattagcctaacatatgggatttgcaatgggagtctttatccagaaccaactttggtgccaactcctccaccagaacttcctacggactgtggaggaccttttgagctgtgggagccaaatacaacattcagttctacgaactttccaaacagctaccctaatctggctttctgtgtttggattttaaatgcacaaaaaggaaagaatatacaacttcattttcaagaatttgacttagaaaatattaacgatgtagttgaaataagagatggtgaagaagctgattccttgctcttagctgtgtacacagggcctggcccagtaaaggatgtgttctctaccaccaacagaatgactgtgcttctcatcactaacgatgtgttggcaagaggagggtttaaagcaaactttactactggctatcacttggggattccagagccatgcaaggcagaccattttcaatgtaaaaatggagagtgtgttccactggtgaatctctgtgacggtcatctgcactgtgaggatggctcagatgaagcagattgtgtgcgttttttcaatggcacaacgaacaacaatggtttagtgcggttcagaatccagagcatatggcatacagcttgtgctgagaactggaccacccagatttcaaatgatgtttgtcaactgctgggactagggagtggaaactcatcaaagccaatcttccctaccgatggtggaccatttgtcaaattaaacacagcacctgatggccacttaatactaacacccagtcaacagtgtttacaggattccttgattcggttacagtgtaaccataaatcttgtggaaaaaaactggcagctcaagacatcaccccaaagattgttggaggaagtaatgccaaagaaggggcctggccctgggttgtgggtctgtattatggcggccgactgctctgcggcgcatctctcgtcagcagtgactggctggtgtccgccgcacactgcgtgtatgggagaaacttagagccatccaagtggacagcaatcctaggcctgcatatgaaatcaaatctgacctctcctcaaacagtccctcgattaatagatgaaattgtcataaaccctcattacaataggcgaagaaaggacaacgacattgccatgatgcatctggaatttaaagtgaattacacagattacatacaacctatttgtttaccggaagaaaatcaagtttttcctccaggaagaaattgttctattgctggttgggggacggttgtatatcaaggtactactgcaaacatattgcaagaagctgatgttcctcttctatcaaatgagagatgccaacagcagatgccagaatataacattactgaaaatatgatatgtgcaggctatgaagaaggaggaatagattcttgtcagggggattcaggaggaccattaatgtgccaagaaaacaacaggtggttccttgctggtgtgacctcatttggatacaagtgtgccctgcctaatcgccccggagtgtatgccagggtctcaaggtttaccgaatggatacaaagttttctacattagcgcatttcttaaactaaacaggaaagtcgcattattttcccattctactctagaaagcatggaaattaagtgtttcgtacaaaaattttaaaaagttaccaaaggtttttattcttacctatgtcaatgaaatgctagggggccagggaaacaaaattttaaaaataataaaattcaccatagcaatacagaataactttaaaataccattaaatacatttgtatttcattgtgaacaggtatttcttcacagatctcatttttaaaattcttaatgattatttttattacttactgttgtttaaagggatgttattttaaagcatataccatacacttaagaaatttgagcagaatttaaaaaagaaagaaaataaattgtttttcccaaagtatgtcactgttggaaataaactgccataaattttctagttccagtttagtttgctgctattagcagaaactcaattgtttctctgtcttttctatcaaaattttcaacatatgcataaccttagtattttcccaaccaatagaaactatttattgtaagcttatgtcacaggcctggactaaattgattttacgttcctcttaaataagttaattaaataaaagataaattaactgatatagtcattgtatattagataaattttacctatttatttcaagcaagtatttttaagtctcaagaaaataatcagacataccaaagaaatgcacctattgcaaatcctggtcttggtttatgtgtgttacagtggatatttctaatatatgaaaacttatttagacacagctgaatcacccatgagaaggtcaaatatgtgtaataaatgaatttgcttca

SEQ ID NO: 7152 - DNA, 2317 bp, Homo sapiens
tcatctggctgctcatctgtatcctttataataaagaaggaatagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctgg

SEQ ID NO: 7153 - DNA, 2639 bp, Homo sapiens
atggacaaagaaaacagcgatgtttcagccgcacctgctgacctgaaaatatccaatatctcagtccaagtggtcagtgcccaaaagaagctgccaccaggaagacgaccaccacaaagacccattggcaaagccaaacccaagaagcaatccaagaaaaaagttcccttttggaatgtacaaaataaaatcattctcttcacagtatttttattcatcctagcagtcatagcctggacacttctgtggctgtatatcagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctggctcacacctgtaatcccagcacgttgggaggccgaggcgggcagatcacgaggtcaggaggtcaagaccatcctggctaacatggtgaaaccctgtctctactg

SEQ ID NO: 7154 - DNA, 2681 bp, Homo sapiens
atggacaaagaaaacagcgatgtttcagccgcacctgctgacctgaaaatatccaatatctcagtccaagtggtcagtgcccaaaagaagctgccaccaggaagacgaccaccacaaagacccattggcaaagccaaacccaagaagcaatccaagaaaaaagttcccttttggaatgtacaaaataaaatcattctcttcacagtatttttattcatcctagcagtcatagcctggacacttctgtggctgtatatcagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtaaatgcagctgggcttcggtcggattactcgtcaaccataggatctgcagacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctggctcacacctgtaatcccagcacgttgggaggccgaggcgggcagatcacgaggtcaggaggtcaagaccatcctggctaacatggtgaaaccctgtctctactg

SEQ ID NO: 7155 - DNA, 2616 bp, Homo sapiens
ataatggacaaagaaaacagcgatgtttcagccgcacctgctgacctgaaaatatccaatatctcagtccaagtggtcagtgcccaaaagaagctgccagtgagacgaccaccgttgccagggagacgactaccattgccaggaagacgaccaccacaaagacccattggcaaagccaaacccaagaagcaatccaagaaaaaagttcccttttggaatgtacaaaataaaatcattctcttcacagtatttttattcatcctagcagtcatagcctggacacttctgtggctgtatatcagtaaaacagaaagcaaagatgctttttactttgctgggatgtttcgcatcaccaacattgagtttcttcccgaataccgacaaaaggagtccagggaatttctttcagtgtcacggactgtgcagcaagtgataaacctggtttatacaacatctgccttctccaaattttatgagcagtctgttgttgcagatgtcagcagcaacaacaaaggcggcctccttgtccacttttggattgtttttgtcatgccacgtgccaaaggccacatcttctgtgaagactgtgttgccgccatcttgaaggactccatccagacaagcatcataaaccggacctctgtggggagcttgcagggactggctgtggacatggactctgtggtactaaatgctgggcttcggtcggattactcgtcaaccataggatctgacaaaggctgctctcagtacttctatgcagagcatctgtctctccactacccgctggagatttctgcagcctcagggaggctgatgtgtcacttcaagctggtggccatagtgggctacctgattcgtctctcaatcaagtccatccaaatcgaagccgacaactgtgtcactgactccctgaccatttacgactcccttttgcccatccggagcagcatcttgtacagaatttgtgaacccacaagaacattaatgtcatttgtttctacaaataatctcatgttggtgacatttaagtctcctcatatacggaggctctcaggaatccgggcatattttgaggtcattccagaacaaaagtgtgaaaacacagtgttggtcaaagacatcactggctttgaagggaaaatttcaagcccatattacccgagctactatcctccaaaatgcaagtgtacctggaaatttcagacttctctatcaactcttggcatagcactgaaattctataactattcaataaccaagaagagtatgaaaggctgtgagcatggatggtgggaaattaatgagcacatgtactgtggctcctacatggatcatcagacaatttttcgagtgcccagccctctggttcacattcagctccagtgcagttcaaggctttcagacaagccacttttggcagaatatggcagttacaacatcagtcaaccctgccctgttggatcttttagatgctcctccggtttatgtgtccctcaggcccagcgttgtgatggagtaaatgactgctttgatgaaagtgatgaactgttttgcgtgagccctcaacctgcctgcaataccagctccttcaggcagcatggccctctcatctgtgatggcttcagggactgtgagaatggccgggatgagcaaaactgcactcaaagtattccatgcaacaacagaacttttaagtgtggcaatgatatttgctttaggaaacaaaatgcaaaatgtgatgggacagtggattgtccagatggaagtgatgaagaaggctgcacctgcagcaggagttcctccgcccttcaccgcatcatcggaggcacagacaccctggaggggggttggccgtggcaggtcagcctccactttgttggatctgcctactgtggtgcctcagtcatctccagggagtggcttctttctgcagcccactgttttcatggaaacaggctgtcagatcccacaccatggactgcacacctcgggatgtatgttcaggggaatgccaagtttgtctccccggtgagaagaattgtggtccacgagtactataacagtcagacttttgattatgatattgctttgctacagctcagtattgcctggcctgagaccctgaaacagctcattcagccaatatgcattcctcccactggtcagagagttcgcagtggggagaagtgctgggtaactggctgggggcgaagacacgaagcagataataaaggctccctcgttctgcagcaagcggaggtagagctcattgatcaaacgctctgtgtttccacctacgggatcatcacttctcggatgctctgtgcaggcataatgtcaggcaagagagatgcctgcaaaggagattcgggtggacctttatcttgtcgaagaaaaagtgatggaaaatggattttgactggcattgttagctggggacatggaagtggacgaccaaactttcctggtgtttacacaagggtgtcaaactttgttccctggattcataaatatgtcccttctcttttgtaattgtaccagttgtatttttactgtgatttatgttaaaaatagatactttaaaatgatgcagtaattggctgggtgcgctgg

SEQ ID NO: 7156 - DNA, 3180 bp, Homo sapiens
atggagcccactgtggctgacgtacacctcgtgcccaggacaaccaaggaagtccccgctctggatgccgcgtgctgtcgagcggccagcattggcgtggtggccaccagccttgtcgtcctcaccctgggagtccttttggccttcctctctacacagggcttccacgtggaccacacggccgagctgcggggaatccggtggaccagcagtttgcggcgggagacctcggactatcaccgcacgctgacgcccaccctggaggcactgctgcactttctgctgcgacccctccagacgctgagcctgggcctggaggaggagctattgcagcgagggatccgggcaaggctgcgggagcacggcatctccctggctgcctatggcacaattgtgtcggctgagctcacagggagacataagggacccttggcagaaagagacttcaaatcaggccgctgtccagggaactccttttcctgcgggaacagccagtgtgtgaccaaggtgaacccggagtgtgacgaccaggaggactgctccgatgggtccgacgaggcgcactgcgagtgtggcttgcagcctgcctggaggatggccggcaggatcgtgggcggcatggaagcatccccgggggagtttccgtggcaagccagccttcgagagaacaaggagcacttctgtggggccgccatcatcaacgccaggtggctggtgtctgctgctcactgcttcaatgagttccaagacccgacgaagtgggtggcctacgtgggtgcgacctacctcagcggctcggaggccagcaccgtgcgggcccaggtggtccagatcgtcaagcaccccctgtacaacgcggacacggccgactttgacgtggctgtgctggagctgaccagccctctgcctttcggccggcacatccagcccgtgtgcctcccggctgccacacacatcttcccacccagcaagaagtgcctgatctcaggctggggctacctcaaggaggacttcctggtcaagccagaggtgctgcagaaagccactgtggagctgctggaccaggcactgtgtgccagcttgtacggccattcactcactgacaggatggtgtgcgctggctacctggacgggaaggtggactcctgccagggtgactcaggaggacccctggtctgcgaggagccctctggccggttctttctggctggcatcgtgagctggggaatcgggtgtgcggaagcccggcgtccaggggtctatgcccgagtcaccaggctacgtgactggatcctggaggccaccaccaaagccagcatgcctctggcccccaccatggctcctgcccctgccgcccccagcacagcctggcccaccagtcctgagagccctgtggtcagcacccccaccaaatcgatgcaggccctcagtaccgtgcctcttgactgggtcaccgttcctaagctacaagaatgtggggccaggcctgcaatggagaagcccacccgggtcgtgggcgggttcggagctgcctccggggaggtgccctggcaggtcagcctgaaggaagggtcccggcacttctgcggagcaactgtggtgggggaccgctggctgctgtctgccgcccactgcttcaaccacacgaaggtggagcaggttcgggcccacctgggcactgcgtccctcctgggcctgggcgggagcccggtgaagatcgggctgcggcgggtagtgctgcaccccctctacaaccctggcatcctggacttcgacctggctgtcctggagctggccagccccctggccttcaacaaatacatccagcctgtctgcctgcccctggccatccagaagttccctgtgggccggaagtgcatgatctccggatggggaaatacgcaggaaggaaatgccaccaagcccgagctcctgcagaaggcgtccgtgggcatcatagaccagaaaacctgtagtgtgctctacaacttctccctcacagaccgcatgatctgcgcaggcttcctggaaggcaaagtcgactcctgccagggtgactctgggggccccctggcctgcgaggaggcccctggcgtgttttatctggcagggatcgtgagctggggtattggctgcgctcaggttaagaagccgggcgtgtacacgcgcatcaccaggctaaagggctggatcctggagatcatgtcctcccagccccttcccatgtctcccccctcgaccacaaggatgctggccaccaccagccccaggacgacagctggcctcacagtcccgggggccacacccagcagacccacccctggggctgccagcagggtgacgggccaacctgccaactcaaccttatctgccgtgagcaccactgctaggggacagacgccatttccagacgccccggaggccaccacacacacccagctaccagactgtggcctggcgccggccgcgctcaccaggattgtgggcggcagcgcagcgggccgtggggagtggccgtggcaggtgagcctgtggctgcggcgccgggaacaccgttgcggggccgtgctggtggcagagaggtggctgctgtcggcggcgcactgcttcgacgtctacggggaccccaagcagtgggcggccttcctaggcacgccgttcctgagcggcgcggaggggcagctggagcgcgtggcgcgcatctacaagcacccgttctacaatctctacacgctcgactacgacgtggcgctgctggagctggcggggccggtgcgtcgcagccgcctggtgcgtcccatctgcctgcccgagcccgcgccgcgacccccggacggcacgcgctgcgtcatcaccggctggggctcggtgcgcgaaggaggctccatggcgcggcagctgcagaaggcggccgtgcgcctcctcagcgagcagacctgccgccgcttctacccagtgcagatcagcagccgcatgctgtgtgccggcttcccgcagggtggcgtggacagctgctcgggtgacgctgggggacccctggcctgcagggagccctctggacggtgggtgctaactggggtcactagctggggctatggctgtggccggccccacttcccaggtgtctatacccgggtggcagctgtgagaggctggataggacagcacatccaggagtga

SEQ ID NO: 7157 - DNA, 1628 bp, Homo sapiens
gcgtgtctctgagccatggagcccactgtggctgacgtacacctcgtgcccaggacaaccaaggaagtccccgctctggatgccgcgtgctgtcgagcggccagcattggcgtggtggccaccagccttgtcgtcctcaccctgggagtccttttggccttcctctctacacagggcttccacgtggaccacacggccgagctgcggggaatccggtggaccagcagtttgcggcgggagacctcggactatcaccgcacgctgacgcccaccctggaggcactgtttgtaagtagttttcagaagacagagttagaggcaagctgcgtgggttgctcggtactgaattatagggatgggaactccagtgtcctcgtacatttccagctgcactttctgctgcgacccctccagacgctgagcctgggcctggaggaggagctattgcagcgagggatccgggcaaggctgcgggagcacggcatctccctggctgcctatggcacaattgtgtcggctgagctcacagggagacataagggacccttggcagaaagagacttcaaatcaggccgctgtccagggaactccttttcctgcgggaacagccagtgtgtgaccaaggtgaacccggagtgtgacgaccaggaggactgctccgatgggtccgacgaggcgcactgcgagtgtggcttgcagcctgcctggaggatggccggcaggatcgtgggcggcatggaagcatccccgggggagtttccgtggcaagccagccttcgagagaacaaggagcacttctgtggggccgccatcatcaacgccaggtggctggtgtctgctgctcactgcttcaatgagttccaagacccgacgaagtgggtggcctacgtgggtgcgacctacctcagcggctcggaggccagcaccgtgcgggcccaggtggtccagatcgtcaagcaccccctgtacaacgcggacacggccgactttgacgtggctgtgctggagctgaccagccctctgcctttcggccggcacatccagcccgtgtgcctcccggctgccacacacatcttcccacccagcaagaagtgcctgatctcaggctggggctacctcaaggaggacttcctggtcaagccagaggtgctgcagaaagccactgtggagctgctggaccaggcactgtgtgccagcttgtacggccattcactcactgacaggatggtgtgcgctggctacctggacgggaaggtggactcctgccagggtgactcaggaggacccctggtctgcgaggagccctctggccggttctttctggctggcatcgtgagctggggaatcgggtgtgcggaagcccggcgtccaggggtctatgcccgagtcaccaggctacgtgactggatcctggaggccaccaccaaagccagcatgcctctggcccccaccatggctcctgcccctgccgcccccagcacagcctggcccaccagtcctgagagccctgtggtcagcacccccaccaaatcgatgcaggccctcagtaccgtgcctcttgactgggtcaccgttcctaagctacaaggtattttcggggcagaaaggtagaagatgatgtacgtgcc

SEQ ID NO: 7158 - DNA, 2251 bp, Homo sapiens
cagttgcttctacaaaacccgtgaaagttctctgtccaaaagccttgttggtcccgcggtacatgcttcctgttcccagagagattcacccttgggctttcctatcagtcttccctaaagttggctgctcctgtgtcctgtcacataaaactgtgaaccgaggtctccgacttacgtcatgtcagtcacagcagggtgaggctccacaagtgtgagttctggcccctgctgctttcctttcaaatgcagtttacagtttattatggtattggacaccccatgctccttactgcattggctttgggtaagaaggagtgaaaattagtgtgcgaacctgaaaacctagaatttctgattgggactgaagaaaacctttgtgctgcagtcagtccccgagccagacgcctgtgactctcttcacatggaaatagatgactatccacagtaaaagcaaaattaaaaagtgacttgtgaaaaatatcctccatgctcctcttaccaagcctgcaacttaaaacctatggtttaaactgtgctttcaattatctggaggaggccagcactgatgagcccatcctgagccagtcattttaaggccagtgctacctaactgagacaaggctaatctggtcgccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtgg

SEQ ID NO: 7159 - DNA, 1753 bp, Homo sapiens
gtcatttaggaacagaggtagcctgaaagaagcaggaactccaggatcccaaaccagagcagaccctatagtaaagtatttttacatcttttcctttccccagaagagatccctaacctattgttttattgacagccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgctaaaacttcttaaatggttgtttctgctatagttatttctattgcagttccaaattgccatcttcccttgtctcatttgcaagttctcaattgtatttctctcaaatggacaggttccttctttactggaggatttttgtttttatcatattggtttttcattacttctgaatagtcttaattacgtttactaaattctaaaggatttctgtgctattataattaggaaatcaacgtctttggtcaggaactttataatgtgctattaaatgtatattacatttttgtgg

SEQ ID NO: 7160 - DNA, 1962 bp, Homo sapiens
cagttgcttctacaaaacccgtgaaagttctctgtccaaaagccttgttggtcccgcggtacatgcttcctgttcccagagagattcacccttgggctttcctatcagtcttccctaaagttggctgctcctgtgtcctgtcacataaaactgtgaaccgaggtctccgacttacgtcatgtcagtcacagcagggtgaggctccacaagtgtgagttctggcccctgctgctttcctttcaaatgcagtttacagtttattatggtattggacaccccatgctccttactgcattggctttgggtaagaaggagtgaaaattagtgtgcgaacctgaaaacctagaatttctgattgggactgaagaaaacctttgtgctgcagtcagtccccgagccagacgcctgtgactctcttcacatggaaatagatgactatccacagtaaaagcaaaattaaaaagtgacttgtgaaaaatatcctccatgctcctcttaccaagcctgcaacttaaaacctatggtttaaactgtgctttcaattatctggaggaggccagcactgatgagcccatcctgagccagtcattttaaggccagtgctacctaactgagacaaggctaatctggtcgccttgctgttagaggctctttcccagaagttggacgaagaggctcaggcgttgctgtttcttgtcttccaagtcaagtggttactctggtaatggattgcctctctccgagctttcaccctggtgagactgtccagatctagtctgtaaacccagcttagaagcactgttgtaaaaatgactgaagagcccatcaaggagatcctgggagccccaaaggctcacatggcagcgacgatggagaagagccccaagagtgaagttgtgatcaccacagtccctctggtcagtgagattcagttgatggctgctacagggggtaccgagctctcctgctaccgctgcatcatcccctttgctgtggttgtcttcatcgccggcatcgtggtcaccgcggtggcttacagcttcaattcccatgggtctattatctccatctttggcctggttgttctgtcatctggactttttttactagcctccagtgccttgtgctggaaagtgagacaaaggagcaagaaagccaagagacgggagagtcaaacagctctcgtggcaaatcagagaagcttgtttgcttgagactgaatacgaccaaatgggccattgggcctggaaaacgtgctctgactttgtcacccaattcacccagaaccatggtgggagagaacagacttggcgttggagcagactggaagaatgggggtgggagggtggaggggcttctcctttgtgaggaatgactcatgtcttctttaacgacaaacttaaccctaagggctacttctgagactgaaaaatcagctttctatttacatgaaacactttgggggtcatgggagtgcacagcattagacagtatttggttcaccctgtaaagtagccaagaaaagatgagaaaaatcaagataggcctggcacactagacatttgcctccaaaagaaataacctacagtcttaagatgtatcataaaaatgttctgccaaggatctaaattaccttgggtttcgcatatgtctatgaaattctgtgataatttttttcaatacattgattcactggcgtctgttttcattttatacttttaataactcatcactggtggtactttatcttgaaaagtaatattttttatattttaacattggacagtgttagccagttgtaatgatgtatcagaagtaaagaaaaacccattaaagttatagctaatagatgctgttgggggttaaattaatagtaaaataatccaatatagcacttttgatgatttttatataaaagtcaactgtacatttcattcagaataataaatacttattgctgct

SEQ ID NO: 7161 - DNA, 1536 bp, Homo sapiens
ccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgcgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatag

SEQ ID NO: 7162 - DNA, 1041 bp, Homo sapiens
gaaaaagaaaaagcgcttgacccggaagctgcgtgtcccatccccgcgcctgcttctctgactggggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagagga

SEQ ID NO: 7163 - DNA, 1830 bp, Homo sapiens
ccagactgcgccgaagcttcatgagacctctcctcgtctgtgcacggacgagtggccgactctggagcccaggctgttgcttcccagactggtggtgaatcctccatagtctgggacaaatatggccctgaaggctccatgagcagacgagaaggctggacttcgcaactgggtcaccttagatccggaactagagaatgacaccgttgtttccgggaggaaaaagaaaaagcgcttgacccggaagctgcgtgtcccatccccgcgcctgcttctctgactggggtgaggccgcagcggactgccctttcccaagatggcgtcgaagataggttcgagacggtggatgttgcagctgatcatgcagttgggttcggtgctgctcacacgctgccccttttggggctgcttcagccagctcatgctgtacgctgagagggctgaggcacgccggaagcccgacatcccagtgccttacctgtatttcgacatgggggcagccgtgctgtgcgctagtttcatgtcctttggcgtgaagcggcgctggttcgcgctgggggccgcactccaattggccattagcacctacgccgcctacatcgggggctacgtccactacggggactggctgaaggtccgtatgtactcgcgcacagttgccatcatcggcggctttcttgtgttggccagcggtgctggggagctgtaccgccggaaacctcgcagccgctccctgcagtccaccggccaggtgttcctgggtatctacctcatctgtgtggcctactcactgcagcacagcaaggaggaccggctggcgtatctgaaccatctcccaggaggggagctgatgatccagctgttcttcgtgctgtatggcatcctggccctggcctttctgtcaggctactacgtgaccctcgctgcccagatcctggctgtactgctgccccctgtcatgctgctcattgatggcaatgttgcttactggcacaacacgcggcgtgttgagttctggaaccagatgaagctccttggagagagtgtgggcatcttcggaactgctgtcatcctggccactgatggctgagttttatggcaagaggctgagatgggcacagggagccactgagggtcaccctgccttcctccttgctggcccagctgctgtttatttatgctttttggtctgtttgtttgatcttttgcttttttaaaattgttttttgcagttaagaggcagctcatttgtccaaatttctgggctcagcgcttgggagggcaggagccctggcactaatgctgtacaggtttttttcctgttaggagagctgaggccagctgcccactgagtctcctgtccctgagaagggagtatggcagggctgggatgcggctactgagagtgggagagtgggagacagaggaaggaagatggagattggaagtgagcaaatgtgaaaaattcctctttgaacctggcagatgcagctaggctctgcagtgctgtttggagactgtgagagggagtgcgtgtgttgacacatgtggatcaggcccaggaagggcacaggggctgagcactacagaagtcacatgggttctcagggtatgccaggggcagaaacagtaccggctctctgtcactcaccttgagagtagagcagaccctgttctgctctgggctgtgaaggggtggagcaggcagtggccagctttgcccttcctgctgtctctgtttctagctccatggttggcctggtgggggtggagttccctcccaaacaccagaccacacagtcctccaaaaataaacattttatatagaca

SEQ ID NO: 7164 - DNA, 4745 bp, Homo sapiens
ggcgcatgcgcgctgcggaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactcaccatgcccaaggcattcgccactgccgggtggcttgtcagcctcgtcctgctggtgttcctgggcttcatgagcttcgtgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgctttcgccgtcatgattgtgctggccctgatccgcatcgggcacggacaaggggaggggcacccgcccctggctgacttctcgggggtccggaacctgtttggggtgtgcgtctactccttcatgtgccagcactctctgccatccctcattacccccgtctcctccaagcgccacctcacaaggctggtgttcctggactacgtgctgatcctggccttctacggcctcctctccttcaccgccatcttctgcttccgcggcgacagcctcatggacatgtacaccctcaacttcgcgcgctgtgacgtcgtgggcctggccgctgtgcgctttttcctgggcctcttccccgtcttcaccatcagcaccaacttccccatcattgccgtgaccctgcgcaacaactggaagacactcttccaccgcgagggcggcacgtacccgtgggtggtggaccgcgtcgtgtttcccaccatcaccctggtgccgcctgtgctggtggccttctgcacccacgacctggagtccctggtgggcatcacaggggcctacgcgggcaccggcatccagtacgtcatccccgccttcctggtgtaccactgccgcagggacacccagctggcctttggctgtggggtcagcaacaagcacaggtcccctttccgccacaccttctgggtgggcttcgtgctgctctgggctttctcctgcttcattttcgtcacggccaatatcatcctcagcgagaccaagctctgatggcaggacaggcaggtctagtgacaggaggcataggggccccagccccacccctcgcccgcagagcccagatttagttgctcccaggtcttcatggggcaggtgggactgtggctctaggggaaaccccctgtccagctggggttgttctccccacccaccttccacccagtctgcacctgtcctcactcccccgggcagctctcccaccaggtccttctgcctgggtgacgcgtggctgctcccaagttctaagactcattactggaatcacacctctcccacatcttccaacacgcttcacccccaaccctacttccagggcgggctactccctgcacaatgggagatgcagtgctggcactgccatcatttgtcccagacccatgcccctcccctctcctgccccatcctgcgtccttgtctaagaaacctccactagcagctgctgcctcttcagaggcgaatcccaggctggaagtatcctagccaggtctgcctgtgacggcagggcccaccctcccaccaggcctgggaggcggtaggtgccacctcagagagggcctggctggccccatgacaagaacaagaagtgctaactggtaccagagtccccagatagagctgcgagggccctcgctgtgggcgcgagctccggagtagcaggctggatggagcatcccttctacagggacacagccgcctgccagctgggcctaaagtctggagcttgtctctgaaagggaccgtctgctgccctcgctgccccactggagccctcagggcctcctacagtgcaggtggtcctactagagggaagccatccccacctggcacctcagcggcttggcagtgacatggcagtgggagggctctgaggttcccaccctgacaatggtcaggctgcccgtgctcccactccaacactaaaagcggctcccttaggggctgagcgtgggtgctcagtgttcacgctatatcccttgggcaatgtggggttggatggggcccccacttccattcccatggaaggaggccaggtccccagccacctcccactcagccatgcacgcacttgctgggctggcctcctgggaaacacaggtgactcgaatgaactctgcattttcaacgtgccttctactgcttcaggacctgggggtccccctgaccctcactggcttgcccccagccctgggcctggccccacctgtcctggagcccagagcccctggcctggagctacctctctggggtgggtctcaggccccacccctccctcttttgagttcagtgccttgctcagcccctcccctgtatctcagcgtcttcagacctctgacagagcgacgatgtagggtctcccggggcccaaggtggtctcagggtcaggggtgggatttgcagggaactcggggagcccacgggctgcgccacctctgccctggcagctgaagcctgggagagtccctgcgtggtgtaattggcctcagcccgctttctctgtgccgtcgcacctcagtgtttctcatagcttgtccccacgtgtcactttccatccacgggaaaaacaaatgccccttctccatctatcattgcgacttcctcccaggaggcctctcaggttgggtagagcaggggcctgcagtggtcaggccaagagcaaggaagacctggctgccccactgtggctgaaaactcaaaacatctggaactacccttctccaattacgttccctcttgcttaaagacaaagctaattaaatcatcctgccacccgaggctccaaaccaaatcttggacgcaaattcattagcttcataaagcccaggttgatttatgtgacagtctggaaccgcccagccatggagtcggtggccgtgttccctgccctggagggaactggccagcagtgaccacatcgctgatgccaagtggggaccctcaccactgccgttgtctagctgctttgctcctcagtgtcctcctgctgtaagtcagatgaggtcaccttcctctccatcgatgccaggcttctgccgctgacggccaatggggcttggggccaggggcagagaaccccaacagcaagagagccccaggtgatgctggctctccacgtgcatccggcacgtttcactgcagccatcatcaacttggcaaagtaggcaagctcagcttgtggtttccattttgcagatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgatacctgtttcccacatcactcaccagcc

SEQ ID NO: 7165 - DNA, 1781 bp, Homo sapiens
ggaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgtgtttgtcagagtggtcaagccaaacaaaatcgccatgctgtttataatgttaatcccgggctgggcacggtggctcacgcctgtaatcccagcactttgggaggctgaagcgggcagatcacctgaggtcaggagttcaagaccagcctggccaacatgcttcgtgaccaccacctttgtgatagaggccatggctgcagccaacgcgcagctccactggaagaggatggagaacctcaaggaggaggaagatgacgactcctccacagcctcagacagcgatgttctcatccgggacaactacgagcgggcagagaagcggcccatcctgtctgtgcagagacgtggatctcccaacccgtttgaaatcacagaccgggtggaaatgggacaaatggcctccatgttcttcaataaagtgggggtcaacttgttctatttctgcatcatcgtttacctgtatggagacctcgccatctatgctgctgccgtgcccttctccctcatgcaggtgacctgcagcgccactggcaatgactcctgcggtgtggaagcagacaccaaatacaatgacactgaccggtgctgggggcccctgcgccgagtggacgcctaccgcatctacttggcgatcttcactctcctcctcggaccgttcaccttctttgacgtccagaagaccaagtacctgcagatcctgacctctctgatgagatggatcgatgggcccccggggtcagtgatgggaagagcagaagaggatgccagcccagcctggcccaggagcaggtgtcgttgtggaggaaagcttaaactcaacagcctctacccaacatctgccacctgcatggccccagatgcccccggtgcaggccaggtcaaggtgggagtaaactttctttgcctccctccccacagaagcaccagacccacctgagccccagagcctcatgccagcagctcctggctgttcctcacctgaggctagagcagcagctgccagcttatagatggggcggatggcaggtgatagactgggaagcactgctgggtggtggaggtgggcagtggcaccatgacgggcccctagccacacagctgtcctcactacggggcagggagcagcctcggcaacaggcaaaggccagagtcagagtggtggggaggacaggggctgctgccccgctcctggaaagccactgcagaggggcagtggctggcagtgccaggcctgggggaagtggaagcgtcctgtctgggggcagattcccaagcaagggtgacccatggttaagggccactggaaagctggagagagcttgggatcccttccacctggggccaatggtgttgattgcagactggaggggtaacctccgctgagggtcattatgtgccaggcatggcattgggtactttctgcattgggaccaggcagccgggcctgccatttgaggcagcgagcctccgtgacctgtcctccctcatttgtaaagtggggtaacagctatgtcactggccagttgtggggattaaagtgctgagcttagtgcccagcccaaaatgctcaataaagctattcagtgat

SEQ ID NO: 7166 - DNA, 3317 bp, Homo sapiens
acactgcgtccccatcagctcaaagaatacgcatggggacaagcctggggggccgtctgagagtcccccaaccctggatccccacggcagcccccactgttgggtttttcagtggctggtgtgccctgggctggtcacctctgcattttgctctgctgggagtttgctcctggccctccaacagcgcctcctctgtgaggaggaactcctgttcccgtggctctgctggctctggaggctggagttcccgtgctgggccctcctgggcgggttctctcttgctgccgccagtaccctgcccctctcgtcctcctgggtagcctgggaggaatggcagaagaaagcagtgaagccaggtagcagtagcccggccaccccaccaggctctgctgtaggctgggctctcaaggcagctgctccaggaggggccccctaggaagggactgccacactcctgggagcgttcctggccccctccagtgcaaatgaccctgggccccaaggctccgaacacccgcccctctgctccaggctagcttggctgagcccgatgcttctcaaggtgaggagggcgtccttgaagcctccggccaccccacaccaaggagctttcagggcaggaaatgtgatcgggcagctgatttatctccttacctggtctttgttcacagcctggctccggccccccaccctgctgcagggcccgaggacgtctccccaggggtccccacctcggtctccttggggggactgtgctgagcccagctgcctctgtgagatgaagataagaaggcgaagacatgaagggcctgcctgggggcagtctggctttcttgcaggggggctgcacctggttccctcctccctctcgctggcagcctgcggggtggtgaggatgaaggggctgtggggccggggtgcagggattagagggaggtgactgccatctcttcctcctcatcgtgtttttcacctcttaagtcaactttagattctcggactcagagttctctcctgacggtggcagggtcctcagatcaccggtgcagacagggccagacagggccaatgtggggacccactcagcctgtggcctctgcaggagggaggtcggaggcctcagcagccaccccggccacctcctgaaacagtgaatgtccttcattttcagctggcaagctctgatcttacaacgaggtatggaactgttcagaaaactttcagcagacgttcgagggaaaacagctcagcttcccatgccccccacctctgccaggagcgaccccatatcccccaaacagaattctggtagcccgggaccacagggtcttcctgtgcctcccctgccagctctgcatgactttgtcacgtacttgagtgctggctgagatgatgctaccgctaccaaacaggtgggaggccagccccagccccagccccagccccaccggggccggagctcccggtgaagaagcgtctgcctggttcgcaggtgtccaggacacaccagtcgcctgactcccggtcaggcaaacgcacacatcaagttcttgcaagccagggctctgctggcatcttcaagaggagggagggtcctggccctgaccacagggctcccttaacaggaggagttacaaactcggcttcctggggggcatcgtggggtgtgctgcctgccaggagaccccactcctggtcacggggttccgtcccacacagtggcaggagccatgcatgattcttggctgaagaagaacccgcacagctatgtggtctgccgcccagcagggaagcccccacatcagccctaagggaacttcccaaagctcagcaggtgcctcttcctgccatccgctaggtcttctcttggcccctctcccaagccttgacccatagctgacacttctagaaaagtctttaccgagaaacggaccggctgcatgggtggtgaggagggcagttgcccagggcctggcatcagaggggcctgtggctaaggctgtcctgaaattcttaatcattttacctctgaacttgcgggtttttgttgttgttttttgaggcagagtcttgctctgtcacccaggctggagtgcagtggtgcgatcttggcttactgcaacttccgactcccaggttcaagcgattctcctgcctcagcctcccgagtagctgggactacagaagtgcaccaccacacccggttaatttttgtatttttagtagagacggggtttcaccatgttggccaggctgatctcaaactcctgatacacccgcctcggcctctcaaagcactgggattacaggtgtgagccaccgcgcccggcccttttcctgcctcctaaacaagtggccaggaattctcctcctgcaccgggtccccagattgtgtggcaagccctgcagatggcacaggggactggttcttcctcgtggaaagccaggcccggacacctctcgggcatcgcctgttggggtgaccctcccacacccagcctggaaccctagccagctcagcctccgtccgctgagaaatcaaggtgaccttgtggctcagccctcagggggcactcaccacacaagagttccctttcaagaccccctgttcggggctggggcccccaggaacggttggggcaccttcctggggccctgtttttccccaggagcggggcctgggagctgagggcgtctcatctccccacaggcatctgctgctgctcctggctgccactcacccctgtgagatgctgagggcaggatacctgtctgtgcggggcgtgggaaaaagggagaaagcctggcagagggttgggggctaagaagcaaagggcgtggaagggccaccgtgcacttttgaagtctctacttgccagtggccaccccacctctccctgccctcatccaaggacggacaggcctggcaggtggaccggagctgtggggcagaagcatcccaggcctggcctcagaggagggaggccatggtgaaagtggaggctgtctgcatccacctccccagcctttgtcaccgggacctcagcctgaccccaggcccaccccaggctgctcaccgaggtgggtaccctgcccaccgccagctcagatgcggtgtgtggactcccttctctctgggggtgagcgggagttccctcccctccacatcaggagctgggggagagctggagggccctgggatccccttgaccctggtcatcagccccagccctgacaggccctgcgtgtgccatgtgtggcctgggtttggagctcagcaccctgcgggaattctattaaatctccgattttatctg

SEQ ID NO: 7167 - DNA, 2795 bp, Homo sapiens
attttcgattccactctcttccgtttctgtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactgagcacctggtcagtctgaagggggcatttcaccccagctccatcagggctggcagtcccgtctgaatgtggagagagctgtagttttatctggcttttaaaacatggacctgccggctgggcgcagtggcttacacctgtaatcccagtactttgggaggccgaagtgggtggatcacttgagggcaggagttcgtgaccagcctggtcaacatggtgaaaccttgtctctactaaaaatacaaaaattagctgggtgtggtggcatgcgcctgtaatcccagctactcgggaggctgaggcagcagaatcacttgaaaccggaaggcagaggttgcagtgagccaagatcgtgcaactgcactccagcctgggcaaaagagcaaaactttgtctcaaaaaaagactcttttcaagttttctaccctctgataagaaaatttggggatatccagtgccatctccaaggactttcaggggatcatagatgcttttctgtgcctatctgctttgaccatgtgaaaaagtgatagtctgcttctctctggtaacttgtctgccacccatctgatagtaagattagccaaggccctttagccctctgtcctttctggttattgactgtccctggttcctaggaagacagagttgttctccagctaaagcgtctcctctctataaagtagttttactattcttttcatagcaggagccaaaatagtagaggaggggagagaggcacctggcactctgcgggcctgcacaggaaaaacagagccaaagacagaatcattgtataagatatttattaaaggagagcctctaagtccacatcctgagcccatgtgagtggacacaggtaggtaaaacggtgggtccagctgctgtcatctgaaagccttcaggagatgaagctatcagtatccagctgaaggctgctgggttctgttccaccaccaccttagcaccagggccctctctggtcccagaggcctcatctctccttgggctttgacaatgtggagcagcacatcagcagggactggtctagaccctccctttcctgtcacttagctggagctaagctccagataacccctaggttcccactggctcctagtagaaatagtttctgtactttagcagaacaggaaggatatttgttcattaaaggtggcttggtcttacagctgggtgcagtggtatatacctgtagtcccagctactcaggaagctgaggtgagaggatctctagagcccaggaattcaagtttaacatgagcagcaacattagcaagaccccgttt

SEQ ID NO: 7168 - DNA, 1181 bp, Homo sapiens
attttcgattccactctcttccgtttctgtcgctgcagtcgtccgcggtgaaacccccgcccctgaagaatgggtaagacgttttcccagctgggctcttggcgggaggatgagaacaagtcaatcctgtcctccaaaccagccattggcagcaaggctgtcaactactccagcaccggtagcagcaagtctttttgttcctgtgtgccttgtgaaggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacctggcctttctgtactga

SEQ ID NO: 7169 - DNA, 1330 bp, Homo sapiens
attttcgattccactctcttccgtttctgtcgctgcagtcgtccgcgggactccggccggttgccggccccaggcggtgcttctccccaccaccgcccagctcagctcagcccagcccagcccactctgcccttagaggcccttctccccaaagacgcactccagaagtctcgccctcgtgcggctgaggagcctgggatcccagacctgaacaagtgaaacccccgcccctgaagaatgggaactgctgatgccagcttcgtgacttgtcccacctgccagggcagtggcaagattccccaagagctggagaagcagttggtggctctcattccctatggggaccagaggctgaagcccaagcacacgaagctctttgtgttcctggccgtgctcatctgcctggtgacctcctccttcatcgtctttttcctgtttccccggtccgtcattgtgcagcctgcaggcctcaactcctccacagtggcctttgatgaggctgatatctacctcaacataacgaatatcttaaacatctccaatggcaactactaccccattatggtgacacagctgaccctcgaggttctgcacctgtccctcgtggtggggcaggtttccaacaaccttctcctacacattggccctttggccagtgaacagatgttttacgcagtagctaccaagatacgggatgaaaacacatacaaaatctgtacctggctggaaatcaaagtccaccatgtgcttttgcacatccagggcaccctgacctgttcatacctgagccattcagagcagctggtctttcagagctatgaatatgtggactgccgaggaaacgcatctgtgccccaccagctgacccctcacccaccatgacctgtctgctgtccctgtactccaggcacctgcaaccctggtctatatctcccacaactccctggtgactaaggaaggactacagaggctttgccaaaggagaagccctgcctcatcacacccttacctcccaccccctcagcacaggaagcttgctttgaagttaacttcatacacacacactcatatcctccagtttcccccagattctttcaggggctgccatcagattctgcccttggttagttttttgttttttttttggtagagacagagtctcactgttggtccaggttggttttgaactcctgggctcaagcgatcctcccttcttggcctcccaaagcacttggattacagatgtgagcctgtgcctggctggtctttcttgaggaaaatctgacctggcattttcttgaggcaccttagattccctggagtggcacct
